(12) United States Patent
Brentjens et al.

(10) Patent No.: US 11,059,891 B2
(45) Date of Patent: Jul. 13, 2021

(54) CHIMERIC ANTIGEN RECEPTORS TARGETING FC RECEPTOR-LIKE 5 AND USES THEREOF

(71) Applicants: MEMORIAL SLOAN-KETTERING CANCER CENTER, New York, NY (US); EUREKA THERAPEUTICS, INC., Emeryville, CA (US)

(72) Inventors: Renier J. Brentjens, New York, NY (US); Eric L. Smith, New York, NY (US); Cheng Liu, Emeryville, CA (US)

(73) Assignees: MEMORIAL SLOAN-KETTERING CANCER CENTER, New York, NY (US); EUREKA THERAPEUTICS, INC., Emeryville, CA (US)

( * ) Notice: Subject to any disclaimer, the term of this patent is extended or adjusted under 35 U.S.C. 154(b) by 769 days.

(21) Appl. No.: 15/614,108

(22) Filed: Jun. 5, 2017

(65) Prior Publication Data

US 2017/0275362 A1  Sep. 28, 2017

Related U.S. Application Data

(63) Continuation of application No. PCT/US2015/064134, filed on Dec. 4, 2015.

(60) Provisional application No. 62/088,164, filed on Dec. 5, 2014.

(51) Int. Cl.
| | |
|---|---|
| C07K 16/00 | (2006.01) |
| C07K 16/28 | (2006.01) |
| A61K 35/17 | (2015.01) |
| C07K 14/725 | (2006.01) |
| C07K 14/705 | (2006.01) |
| C12N 9/12 | (2006.01) |
| A61K 39/00 | (2006.01) |
| C07K 16/30 | (2006.01) |
| C12N 5/0783 | (2010.01) |
| C12N 15/86 | (2006.01) |

(52) U.S. Cl.
CPC ............ *C07K 16/283* (2013.01); *A61K 35/17* (2013.01); *A61K 39/0011* (2013.01); *A61K 39/001129* (2018.08); *C07K 14/7051* (2013.01); *C07K 14/7056* (2013.01); *C07K 14/70517* (2013.01); *C07K 14/70521* (2013.01); *C07K 14/70578* (2013.01); *C07K 16/3061* (2013.01); *C12N 5/0636* (2013.01); *C12N 9/1205* (2013.01); *C12N 15/86* (2013.01); *A61K 2039/505* (2013.01); *A61K 2039/5156* (2013.01); *C07K 2317/31* (2013.01); *C07K 2317/34* (2013.01); *C07K 2317/54* (2013.01); *C07K 2317/55* (2013.01); *C07K 2317/56* (2013.01); *C07K 2317/565* (2013.01); *C07K 2317/622* (2013.01); *C07K 2317/92* (2013.01); *C07K 2319/02* (2013.01); *C07K 2319/03* (2013.01); *C07K 2319/33* (2013.01); *C07K 2319/40* (2013.01); *C07K 2319/74* (2013.01); *C12N 2510/00* (2013.01); *C12N 2740/10043* (2013.01); *C12N 2740/13043* (2013.01); *C12N 2840/203* (2013.01)

(58) Field of Classification Search
None
See application file for complete search history.

(56) References Cited

U.S. PATENT DOCUMENTS

| | | | |
|---|---|---|---|
| 4,956,778 | A | 9/1990 | Naito |
| 5,091,513 | A | 2/1992 | Huston et al. |
| 5,132,405 | A | 7/1992 | Huston et al. |
| 5,399,346 | A | 3/1995 | Anderson et al. |
| 5,840,344 | A | 11/1998 | Fukushima |
| 7,129,053 | B1 | 10/2006 | Reiter et al. |
| 7,446,190 | B2 | 11/2008 | Sadelain et al. |
| 7,521,541 | B2 | 4/2009 | Eigenbrot et al. |
| 8,344,111 | B2 | 1/2013 | Bachmann et al. |
| 8,389,282 | B2 | 3/2013 | Sadelain et al. |
| 8,399,645 | B2 | 3/2013 | Campana et al. |
| 8,497,118 | B2 | 7/2013 | Jensen |
| 8,802,374 | B2 | 8/2014 | Jensen |
| 2005/0196754 | A1 | 9/2005 | Drmanac et al. |
| 2010/0228007 | A1 | 9/2010 | Hoogenboom et al. |
| 2010/0260748 | A1 | 10/2010 | Elkins et al. |
| 2011/0171125 | A1 | 7/2011 | Elkins et al. |
| 2014/0243504 | A1 | 8/2014 | Davis et al. |
| 2015/0098900 | A1 | 4/2015 | Ebens et al. |

(Continued)

FOREIGN PATENT DOCUMENTS

| | | |
|---|---|---|
| JP | 2012-522512 A | 9/2012 |
| JP | 2012-522513 A | 9/2012 |
| JP | 2017-513818 A | 6/2017 |

(Continued)

OTHER PUBLICATIONS

Allen, "Ligand-Targeted Therapeutics in Anticancer Therapy," Nat. Rev. Cancer 2:750-763 (2002).

(Continued)

*Primary Examiner* — Michael D Burkhart
(74) *Attorney, Agent, or Firm* — Baker Botts L.L.P.

(57) ABSTRACT

The presently disclosed subject matter provides for methods and compositions for treating a neoplasia (e.g., multiple myeloma). It relates to chimeric antigen receptors (CARs) that specifically target Fc Receptor-like 5 (FcRL5), e.g., domain 9 of FcRL5, and immunoresponsive cells comprising such CARs. The presently disclosed FcRL5-targeted CARs have enhanced immune-activating properties, including anti-tumor activity.

63 Claims, 40 Drawing Sheets
Specification includes a Sequence Listing.

(56) References Cited

U.S. PATENT DOCUMENTS

2018/0371085 A1* 12/2018 Brentjens ............... A61P 35/00

FOREIGN PATENT DOCUMENTS

| WO | WO 2002/002641 A2 | 1/2002 |
|---|---|---|
| WO | WO 2006/039238 A2 | 4/2006 |
| WO | WO 2006/076691 A2 | 7/2006 |
| WO | WO 2010/114940 A1 | 10/2010 |
| WO | WO 2010/120561 A1 | 10/2010 |
| WO | WO 2014/087010 A1 | 6/2014 |
| WO | WO 2014/134165 A1 | 9/2014 |
| WO | WO 2014/191128 A1 | 12/2014 |
| WO | WO 2014/210064 A1 | 12/2014 |
| WO | WO 2015/142675 A2 | 9/2015 |
| WO | WO 2016/090337 A1 | 6/2016 |
| WO | WO 2017/096120 A1 | 6/2017 |

OTHER PUBLICATIONS

Altschul, et al., "Basic Local Alignment Search Tool," J. Mol. Biol. 215:403-410 (1990).
Altschul et al., "Gapped BLAST and PSI-BLAST: a new generation of protein database search programs," Nucleic Acids Res. 25(17):3389-3402 (1997).
Amon et al., "Monoclonal Antibodies for Immunotargeting of Drugs in Cancer Therapy," in Monoclonal Antibodies and Cancer Therapy, Reisfeld et al. (eds.), pp. 243-256 (1985).
Azinovic et al., "Survival benefit associated with human anti-mouse antibody (HAMA) in patients with B-cell malignancies," Cancer Immunol Immunother 55:1451-1458 (2006).
Bird et al., "Single-Chain Antigen-Binding Proteins," Science 242(4877):423-426 (1988).
Brennan et al., "Preparation of Bispecific Antibodies by Chemical Recombination of Monoclonal Immunoglobulin G1 Fragments," Science 229:81-83 (1985).
Brown et al., "Tolerance to Single, but not Multiple, Amino Acid Replacements in Antibody V-H CDR2: A Means of Minimizing B Cell Wastage from Somatic Hypermutation?" The Journal of Immunology, The American Association of Immunologists, 126:3285-3291 (1996).
Caron et al., "Engineered Humanized Dimeric Forms of IgG are More Effective Antibodies," J Exp Med 176:1191-1195 (1992).
Coico (Koyko) et al., "Immunology," translation from English, edited by N.B. Serebryanaya, Mosow, "Akademiya," 2008, p. 37 (in Russian with an English translation).
Colman, "Effects of amino acid sequence changes on antibody-antigen interactions," Research in Immunology, 145(1): 33-36 (1994).
Cuesta et al., "Multivalent antibodies: when design surpasses evolution," Trends in Biotechnology 28(7):355-362 (2010).
Flatman et al., "Process analytics for purification of monoclonal antibodies," J. Chromatogr. B 848:79-87 (2007).
Frigyesi et al., "Robust isolation of malignant plasma cells in multiple myeloma," Blood 123(9):1336-1340 (2014).
Garfall et al., "Immunotherapy with Chimeric Antigen Receptors for Multiple Myeloma," Discov Med., 17(91):37-46 (2014).
Gershoni et al., "Epitope mapping—The first step in developing epitope-based vaccines," Biod, Adis International Ltd., NZ, 21(3):145-156 (2007).
Glennie et al., "Preparation and performance of bispecific F(ab' gamma)2 antibody containing thioether-linked Fab' gamma fragments," J. Immunol. 139:2367-2375 (1987).
Harris et al., "Crystallographic Structure of an Intact IgG1 Monoclonal Antibody," Journal of Molecular Biology 275:861-872 (1998).
Hellstrom et al., "Antibodies for Drug Delivery," in Controlled Drug Delivery (2nd Ed.), Robinson et al. (eds.), pp. 623-653 (1987).
Yeger, L., "Clinical Immunology and Allergology," (1990) 2nd ed., translation from German, Mosow, Meditsina in 3 volumes, vol. 1, pp. 219-222 (in Russian with an English translation).

Karpovsky et al., "Production of Target-Specific Effector Cells Using Hetero-Cross-Linked Aggregates Containing Anti-Target Cell and Anti-Fcγ Receptor Antibodies," J. Exp. Med. 160:1686-1701 (1984).
Klechevsky et al., "Antitumor activity of immunotoxins with T-cell receptor-like specificity against human melanoma xenografts," Cancer Res 68(15):6360-6367 (2008).
Kochenderfer et. al., "Adoptive transfer of syngeneic T cells transduced with a chimeric antigen receptor that recognizes murine CD19 can eradicate lymphoma and normal B cells," Blood, 116(19):3875-3886 (2010).
Liu et al., "Heteroantibody duplexes target cells for lysis by cytotoxic T lymphocytes," Proc. Natl. Acad. Sci. USA 82:8648-8652 (1985).
Long et al., "4-1BB Costimulation Ameliorates T cell Exhaustion Induced by Tonic Signaling of Chimeric Antigen Receptors," Nat Med 21(6):581-590 (2015).
Mariuzza et al., "The Structural Basis of Antigen-Antibody Recognition," Annual Review of Biophysis and Biophysical Chemistry 16:139-159 (1987).
McCafferty et al., "Phage antibodies: filamentous phage displaying antibody variable domains," Nature 348:552-554 (1990).
Meyers et al., "Optimal alignments in linear space," Cabios 4(1):11-17 (1988).
Needleman et al., "A General Method Applicable to the Search for Similarities in the Amino Acid Sequence of Two Proteins," J. Mol. Biol. 48:443-453 (1970).
Ozhegov, S.I. The Thesaurus of the Russian Language: 80,000 words and idioms / S.I. Ozhegov and N. Yu Shvedova; Russian Academy of Sciences, Institute of the Russian Language named after V.V. Vinogradov.—4th Edition, updated—Moscow: [ATEIVIP}, 2006. 1:375 (in Russian with an English translation).
Parkman, R., "Clonal analysis of murine graft-vs-host disease. I. Phenotypic and functional analysis of T lymphocyte clones," J. Immunol. 136:3543-3548 (1986).
Pastan et al., "Immunotoxins in cancer therapy," Curr. Opin. Investig. Drugs 3(7):1089-1091 (2002).
Paulus, "Preparation and Biomedical Applications of Bi specific Antibodies," Behring Ins. Mitt. 78: 118-132 (1985).
Payne, "Progress in immunoconjugate cancer therapeutics," Cancer Cell 3:207-212 (2003).
Persic et al., "An integrated vector system for the eukaryotic expression of antibodies or their fragments after selection from phage display libraries," Gene 187:9-18 (1997).
Roitt et al., Immunology, Moscow, "MIR", pp. 110-111 (2000) (in Russian with an English translation).
Rudikoff et al. "Single amino acid substitution altering antigen-binding specificity." Immunology, Proc. Natl. Acad. Sci. USA, 79:1979-1983 (1982).
Sakahara et al., "Effect of DTPA Conjugation on the Antigen Binding Activity and Biodistribution of Monoclonal Antibodies Against α-Fetoprotein", J Nucl Med, 26:750-755 (1985).
Singer et al., Genes and Genomes, Moscow "Mir", pp. 63-64 (1998) (In Russian—not translated into English).
Tai et al., "Antibody-Based Therapies in Multiple Myeloma," Bone Marrow Research Article ID: 924058 (2011).
Tang et al., "The Foxp3+ regulatory T cell: a jack of all trades, master of regulation," Nat Immunol., 9(3):239-44 (2008).
Thorpe et al., "The Preparation and Cytotoxic Properties of Antibody-Toxin Conjugates," Immunol. Rev., 62:119-158 (1982).
Thorpe, "Antibody Carriers of Cytotoxic Agents in Cancer Therapy: A Review," in Monoclonal Antibodies '84: Biological and Clinical Applications, Pinchera et al. (eds.), pp. 475-506 (1985).
Tomimatsu et al., "Production of Human Monoclonal Antibodies against FcεRIα by a Method Combining in Vitro Immunization with Phage Display," Biosci Biotechnol Biochem 73(7):1465-1469 (2009).
Trail et al., "Monoclonal antibody drug immunoconjugates for targeted treatment of cancer," Cancer Immunol. Immunother. 52:328-337 (2003).
Ward et al., "Binding activities of a repertoire of single immunoglobulin variable domains secreted from *Escherichia coli*," Nature 341:544-546 (1989).

(56) References Cited

OTHER PUBLICATIONS

Zhong et al., "Chimeric Antigen Receptors Combining 4-1BB and CD28 Signaling Domains Augment PI3kinase/AKT/Bcl-XL Activation and CD8+ T Cell-mediated Tumor Eradication," Mol Ther 18(2):413-420 (2010).
Boissel et al., "Retargeting NK-92 cells by means of CD19- and CD20-specific chimeric antigen receptors compares favorably with antibody-dependent cellular cytotoxicity," Oncoimmunology, 2(10):e26527 (2013).
Supplementary European Search Report dated Apr. 30, 2018 in Application No. EP 15864773.
An et al., "Chromosome 1q21 gains confer inferior outcomes in multiple myeloma treated with bortezomib but copy number variation and percentage of plasma cells involved have no additional prognostic value," Haematologica 99(2):353-359 (2014).
Anderson, "Prospects for Human Gene Therapy," Science 226(4673):401-409 (1984).
Ausubel et al., Current Protocols in Molecular Biology, John Wiley & Sons Inc., New York, 2003.
Bataille et al., "The phenotype of normal, reactive and malignant plasma cells. Identification of "many and multiple myelomas" and of new targets for myeloma therapy," Haematologica 91:1234-1240 (2006).
Benton et al., "Screening λgt Recombinant Clones by Hybridization to Single Plaques in situ," Science 196(4286):180-182 (1977).
Bertilaccio et al., "Low-Dose Lenalidomide Improves CAR-Based Immunotherapy in CLL by Reverting T-Cell Defects In Vivo," Blood 122:4171 (2013).
Blömer et al., "Highly Efficient and Sustained Gene Transfer in Adult Neurons with a Lentivirus Vector," Journal of Virology 71(9):6641-6649 (1997).
Boyd et al., "The Clinical Impact and Molecular Biology of del(17p) in Multiple Myeloma Treated with Conventional or Thalidomide-Based Therapy," Genes, Chromosomes & Cancer 50:765-774 (2011).
Bregni et al., "Human Peripheral Blood Hematopoietic Progenitors Are Optimal Targets of Retroviral-Mediated Gene Transfer," Blood 80(6):1418-1422 (1992).
Brentjens et al., "CD19-Targeted T Cells Rapidly Induce Molecular Remissions in Adults with Chemotherapy-Refractory Acute Lymphoblastic Leukemia," Science Translational Medicine 5:177ra38 (2013).
Brentjens et al., "Eradication of systemic B-cell tumors by genetically targeted human T lymphocytes co-stimulated by CD80 and interleukin-15," Nature Medicine 9(3):279-286 (2003).
Brentjens et al., "Genetically Targeted T Cells Eradicate Systemic Acute Lymphoblastic Leukemia Xenografts," Clin Cancer Res 13(18):5426-5435 (2007).
Brentjens et al., "Safety and persistence of adoptively transferred autologous CD19-targeted T cells in patients with relapsed or chemotherapy refractory B-cell leukemias," Blood 118(18):4817-4828 (2011).
Brigham et al., "Rapid Communication: In vivo Transfection of Murine Lungs with a Functioning Prokaryotic Gene Using a Liposome Vehicle," Am. J. Med. Sci. 298(4):278-281 (1989).
Brocks et al., "A TNF receptor antagonistic scFv, which is not secreted in mammalian cells, is expressed as a soluble mono- and bivalent scFv derivative in insect cells," Immunotechnology 3:173-184 (1997).
Cayouette et al., "Adenovirus-Mediated Gene Transfer of Ciliary Neurotrophic Factor Can Prevent Photoreceptor Degeneration in the Retinal Degeneration (rd) Mouse," Human Gene Therapy 8:423-430 (1997).
Cornetta et al., "Gene Transfer into Primates and Prospects for Gene Therapy in Humans," Progress in Nucleic Acid Research and Molecular Biology 36:311-322 (1987).
Danos et al., "Safe and efficient generation of recombinant retroviruses with amphotropic and ecotropic host ranges," Proc. Natl. Acad Sci. USA 85:6460-6464 (1988).
Davila et al., "Efficacy and Toxicity Management of 19-28z CAR T Cell Therapy in B Cell Acute Lymphoblastic Leukemia," Science Translational Medicine 6:224ra25 (2014).
Dement-Brown et al., "Fc receptor-like 5 promotes B cell proliferation and drives the development of cells displaying switched isotypes," Journal of Leukocyte Biology 91:59-67 (2012).
Dudley et al., "Adoptive Cell Therapy for Patients with Metastatic Melanoma: Evaluation of Intensive Myeloablative Chemoradiation Preparative Regimens," J Clin Oncol. 26(32):5233-5239 (2008).
Dupont et al., "Artificial Antigen-Presenting Cells Transduced with Telomerase Efficiently Expand Epitope-Specific, Human Leukocyte Antigen—Restricted Cytotoxic T Cells," Cancer Res 65(12):5417-5427 (2005).
Eglitis et al., "Retroviral Vectors for Introduction of Genes into Mammalian Cells," BioTechniques 6(7):608-614 (1988).
Elkins et al., "FcRL5 as a Target of Antibody-Drug Conjugates for the Treatment of Multiple Myeloma," Molecular Cancer Therapeutics 11(10):2222-2232 (2012).
Felgner et al., "Lipofection: A highly efficient, lipid-mediated DNA-transfection procedure," Proc. Natl. Acad. Sci. USA 84:7413-7417 (1987).
Fife et al., "Inhibition of T cell activation and autoimmune diabetes using a B cell surface-linked CTLA-4 agonist," J Clin Invest 116(8):2252-2261 (2006).
Franco et al., "Human Fc Receptor-Like 5 Binds Intact IgG via Mechanisms Distinct from Those of Fc Receptors," Journal of Immunology 190:5739-5746 (2013).
Friedman, "Progress toward Human Gene Therapy," Science 244(4910):1275-1281 (1989).
Gade et al., "Targeted Elimination of Prostate Cancer by Genetically Directed Human T Lymphocytes," Cancer Res 65(19):9080-9088 (2005).
Gahrton et al., "Allogeneic Bone Marrow Transplantation in Multiple Myeloma," Bone Marrow Transplantation in Multiple Myeloma, The New England Journal of Medicine 325(18):1267-1273 (1991).
Giomarelli et al., "Inhibition of thrombin-inducedplatelet aggregation using human single-chain Fv antibodies specific for TREM-like transcript-I," Thromb Haemost 97:955-963 (2007).
Gong et al., "Cancer Patient T Cells Genetically Targeted to Prostate-Specific Membrane Antigen Specifically Lyse Prostate Cancer Cells and Release Cytokines in Response to Prostate-Specific Membrane Antigen," Neoplasia 1(2):123-127 (1999).
Grunstein et al., "Colony hybridization: A method for the isolation of clofted DNAs that contain a specific gene," Proc. Nat. Acad. Sci., USA 72(10):3961-3965 (1975).
Guide to Molecular Cloning Techniques, Guide to Molecular Cloning Techniques, vol. 152, eds. Berger and Kimmel 1987, Academic Press, New York.
Hatzivassiliou et al., "IRTA1 and IRTA2, Novel Immunoglobulin Superfamily Receptors Expressed in B Cells and Involved in Chromosome 1q21 Abnormalities in B Cell Malignancy," Immunity 14:277-289 (2001).
Ho et al., "Inhibition of Cocaine Binding to the Human Dopamine Transporter by a Single Chain Anti-Idiotypic Antibody: Its Cloning, Expression and Functional Properties," BioChim Biophys Acta 1638(3):257-266 (2003).
Hollyman et al., "Manufacturing Validation of Biologically Functional T Cells Targeted to CD19 Antigen for Autologous Adoptive Cell Therapy," J Immunother 32:169-180 (2009).
Hughes et al., "Retroviral Gene Transfer to Primitive Normal and Leukemic Hematopoietic Cells Using Clinically Applicable Procedures," J. Clin. Invest. 89:1817-1824 (1992).
Hunder et al., "Treatment of Metastatic Melanoma with Autologous CD4+ T cells against NY-ESO-1," N Engl J Med 358:2698-2703 (2008).
Huston et al., "Protein engineering of antibody binding sites: Recovery of specific activity in an anti-digoxin single-chain Fv analogue produced in *Escherichia coli*," Proc. Natl. Acad. Sci. USA 85:5879-5883 (1988).
International Search Report dated Mar. 11, 2016 in International Application No. PCT/US15/64134.

(56) References Cited

OTHER PUBLICATIONS

Ise et al. "Sandwich ELISAs for soluble immunoglobulin superfamily receptor translocation-associated 2 (IRTA2)/FcRH5 (CD307) proteins in human sera," Clinical Chemistry and Laboratory Medicine 44(5):594-602 (2006).
Ise et al., "Elevation of Soluble CD307 (IRTA2/FcRH5) Protein in the Blood and Expression on Malignant Cells of Patients with Multiple Myeloma, Chronic Lymphocytic Leukemia, and Mantle Cell Lymphoma," Leukemia 21:169-174 (2007).
Ise et al., "Immunoglobulin Superfamily Receptor Translocation Associated 2 Protein on Lymphoma Cell Lines and Hairy Cell Leukemia Cells Detected by Novel Monoclonal Antibodies," Clinical Cancer Research 11:87-96 (2005).
Johnson, "Gene Therapy for Cystic Fibrosis," Chest 107:77S-83S (1995).
Kabat et al. Sequences of Proteins of Immunological Interest, vol. I, Fifth Edition, U.S. Department of Health and Human Services, NIH Publication No. 91-3242 (1991).
Kabat et al., Sequences of Proteins of Immunological Interest, 4th Edition, U. S. Department of Health and Human Services, National Institutes of Health (1987).
Kershaw et al., "Gene-Engineered T Cells as a Superior Adjuvant Therapy for Metastatic Cancer," J Immunol 173:2143-2150 (2004).
Kido et al., "Use of a retroviral vector with an internal opsin promoter to direct gene expression to retinal photoreceptor cells," Current Eye Research 15:833-844 (1996).
Kimmel, "Identification and Characterization of Specific Clones: Strategy for Confirming the Validity of Presumptive Clones," Methods in Enzymology 152:507-511 (1987).
Krause et al., "Antigen-dependent CD28 Signaling Selectively Enhances Survival and Proliferation in Genetically Modified Activated Human Primary T Lymphocytes," J. Exp. Med. 188(4):619-626 (1998).
Le Gal La Salle et al., "An Adenovirus Vector for Gene Transfer into Neurons and Glia in the Brain," Science 259(5097):988-990 (1993).
Ledbetter et al., "Agonistic Activity of a CD4O-Specific Single-Chain Fv Constructed from the Variable Regions of mAb G28-5," Crit Rev Immunol 17:427-435 (1997).
Lyddane et al., "Cutting Edge: CD28 Controls Dominant Regulatory T cell Activity during Active Immunization," J Immunol. 176:3306-3310 (2006).
Maher et al., "Human T-lymphocyte cytotoxicity and proliferation directed by a single chimeric TCRζ/CD28 receptor," Nat. Biotechnol. 20:70-75 (2002).
Miller et al., "Cloning and Expression of a Yeast Ubiquitin-Protein Cleaving Activity in *Escherichia Coli*," Biotechnology 7:698-704 (1989).
Miller et al., "Generation of Helper-Free Amphotropic Retroviruses That Transduce a Dominant-Acting, Methotrexate-Resistant Dihydrofolate Reductase Gene," Mol Cell Biol. 5(3):431-437 (1985).
Miller et al., "Redesign of Retrovirus Packaging Cell Lines to Avoid Recombination Leading to Helper Virus Production," Mol. Cell. Biol. 6(8):2895-2902 (1986).
Miller, "Retrovirus Packaging Cells," Human Gene Therapy 1:5-14 (1990).
Miyoshi et al., "Stable and efficient gene transfer into the retina using an HIV-based lentiviral vector," Proc. Natl. Acad. Sci. USA 94:10319-10323 (1997).
Moen, "Directions in Gene Therapy," Blood Cells 17:407-416 (1991).
Moosmayer et al., "A single-chain TNF receptor antagonist is an effective inhibitor of TNF mediated cytotoxicity," Therapeutic Immunol 2:31-40 (1995).
Morgan et al., "Cancer Regression in Patients After Transfer of Genetically Engineered Lymphocytes," Science 314:126-129 (2006).
Morgan et al., "Case Report of a Serious Adverse Event Following the Administration of T cells Transduced with a Chimeric Antigen Receptor Recognizing ERBB2," Molecular Therapy 18(4):843-851 (2010).

Naldini et al., "In Vivo Gene Delivery and Stable Transduction of Nondividing Cells by a Lentiviral Vector," Science 272(5259):263-267 (1996).
Ono et al., "Plasmid DNAs directly injected into mouse brain with lipofectin can be incorporated and expressed by brain cells," Neuroscience Letters 117:259-263 (1990).
Panelli et al., "A Tumor-Infiltrating Lymphocyte from a Melanoma Metastasis with Decreased Expression of Melanoma Differentiation Antigens Recognizes MAGE-12," J Immunol 164:4382-4392 (2000).
Panelli et al., "Expansion of Tumor-T Cell Pairs from Fine Needle Aspirates of Melanoma Metastases," J Immunol 164:495-504 (2000).
Papanicolaou et al., "Rapid expansion of cytomegalovirus—specific cytotoxic T lymphocytes by artificial antigen-presenting cells expressing a single HLA allele," Blood 102:2498-2505 (2003).
Pegram et al., "Tumor-targeted T cells modified to secrete IL-12 eradicate systemic tumors without need for prior conditioning," Blood 119(18):4133-4141 (2012).
Peter et al., "Protective effects of an anti-melanocortin-4 receptor scFv derivative in lipopolysaccharide-induced cachexia in rats," J Cachexia Sarcopenia Muscle 4:79-88 (2013).
Peter et al., "scFv Single Chain Antibody Variable Fragment as Inverse Agonist of the β2-Adrenergic Receptor," J Biol. Chem 278(38):36740-36747 (2003).
Riviere et al., "Novel Strategies for Cancer Therapy: The Potential of Genetically Modified T Lymphocytes," Curr Hematol Rep 3:290-297 (2004).
Roberts et al., "Vaccination with CD20 peptides induces a biologically active, specific immune response in mice," Blood 99:3748-3755 (2002).
Rosenberg et al., "Adoptive cell transfer: a clinical path to effective cancer immunotherapy," Nat. Rev. Cancer 8:299-308 (2008).
Rosenberg et al., "Gene Transfer Into Humans—Immunotherapy of Patients With Advanced Melanoma, Using Tumor-Infiltrating Lymphocytes Modified by Retroviral Gene Transduction," N Engl J Med 323:570-578 (1990).
Sadelain et al., "Targeting Tumours With Genetically Enhanced T Lymphocytes," Nat Rev Cancer 3:35-45 (2003).
Sadelain et al., "The basic principles of chimeric antigen receptor (CAR) design," Cancer Discovery 3(4):388-398 (2013).
Sadelain et al., "The promise and potential pitfalls of chimeric antigen receptors," Curr Opin Immunol 21:215-223 (2009).
Sambrook, Fritsch and Maniatis, Molecular Cloning: A Laboratory Manual (2d ed.), CSH Press, 1989.
Sharp, "Gene Therapy," The Lancet 337:1277-1278 (1991).
Shaughnessy Jr., et al., "A validated gene expression model of high-risk multiple myeloma is defined by deregulated expression of genes mapping to chromosome 1," Blood 109(6):2276-2284 (2007).
Shen et al., "Engineering Peptide Linkers for scFv Immunosensors," Anal Chem. 80(6):1910-1917 (2008).
Shieh et al., "Transgenic Expression of Single-Chain Anti-CTLA-4 Fv on β Cells Protects Nonobese Diabetic Mice from Autoimmune Diabetes," J Immunol. 183:2277-2285 (2009).
Siegel et al., "Cancer Statistics, 2013," CA Cancer J Clin 63:11-30 (2013).
Stephan et al., "T cell-encoded CD80 and 4-1BBL induce auto- and transcostimulation, resulting in potent tumor rejection," Nat. Med 13(12):1440-1449 (2007).
Straubinger et al., "Liposomes as Carriers for Intracellular Delivery of Nucleic Acids," Methods in Enzymology 101:512-527 (1983).
Tolstoshev et al., "Gene expression using retroviral vectors," Current Opinion in Biotechnology 1:55-61 (1990).
Wahl et al., "Investigative Nuclear Medicine," J. Nucl Med. 24:316-325 (1983).
Wahl et al., "Molecular Hybridization of Immobilized Nucleic Acids: Theoretical Concepts and Practical Considerations," Methods Enzymol. 152:399-407 (1987).
Wolff et al., "Direct Gene Transfer into Mouse Muscle in Vivo," Science 247(4949):1465-1468 (1990).
Wu et al., "Receptor-mediated Gene Delivery and Expression in Vivo," Journal of Biological Chemistry 263(29):14621-14624 (1988).
Wu et al., "Targeting Genes: Delivery and Persistent Expression of a Foreign Gene Driven by Mammalian Regulatory Elements in Vivo," Journal of Biological Chemistry 264(29):16985-16987 (1989).

(56) References Cited

OTHER PUBLICATIONS

Xie et al., "Direct demonstration of MuSK involvement in acetylcholine receptor clustering through identification of agonist ScFv," Nat Biotech 15:768-771 (1997).
Xu et al., "Correction of the enzyme deficiency in hematopoietic cells of Gaucher patients using a clinically acceptable retroviral supernatant transduction protocol," Exp. Hemat. 22:223-230 (1994).
Yasmina et al., "Probing the binding mechanism and affinity of tanezumab, a recombinant humanized anti-NGF monoclonal antibody, using a repertoire of biosensors," Protein Science 17:1326-1335 (2008).
Zhao et al., "Characteristics of an scFv Antibody Fragment That Binds to Immunoglobulin G of Graves' Disease Patients and Inhibits Autoantibody-Mediated Thyroid-Stimulating Activity," Hybridoma 27(6):445-451 (2008).
Perez De La Lastra et al., "Epitope mapping of 10 monoclonal antibodies against the pig analogue of human membrane cofactor protein (MCP)," Immunology, 96:663-670 (1999).
Supplementary Partial European Search Report dated Sep. 30, 2019 in EP Application No. 16871553.
U.S. Appl. No. 15/997,155 (US 2018/0371085), filed Jun. 4, 2018 (Dec. 27, 2018).
International Search Report dated May 8, 2017 in International Application No. PCT/US16/64550.
U.S. Appl. No. 17/143,833, filed Jan. 7, 2021.

\* cited by examiner

Domain 1-8
Domain 9
TM
Myc3

>MSK_delDOM9_myc_mCD8
MLLWVILLVLAPVSGQFARTPRPIIFLQPPWTTVFQGERVTLTCKGFRFYSPQKTKWYHRYLGKEILRET
PDNILEVQESGEYRCQAQGSPLSSPVHLDFSSASLILQAPLSVFEGDSVVLRCRAKAEVTLNNTIYKNDN
VLAFLNKRTDFHIPHACLKDNGAYRCTGYKESCCPVSSNTVKIQVQEPFTRPVLRASSFQPISGNPVTLT
CETQLSLERSDVPLRFRFFRDDQTLGLGWSLSPNFQITAMWSKDSGFYWCKAATMPHSIISDSPRSWIQV
QIPASHPVLTLSPEKALNFEGTKVTLHCETQEDSLRTLYRFYHEGVPLRHKSVRCERGASISFSLTTENS
GNYYCTADNGLGAKPSKAVSLSVTVPVSHPVLNLSSPEDLIFEGAKVTLHCEAQRGSLPILYQFHHEDAA
LERRSANSAGGVAISFSLTAEHSGNYYCTADNGFGPQRSKAVSLSITVPVSHPVLTLSSAEALTFEGATV
TLHCEVQRGSPQILYQFYHEDMPLWSSSTPSVGRVSFSFSLTEGHSGNYYCTADNGFGPQRSEVVSLFVT
VPVSRPILTLRVPRAQAVVGDLLELHCEAPRGSPPILYWFYHEDVTLGSSSAPSGGEASFNLSLTAEHSG
NYSCEANNGLVAQHSDTISLSVIVPVSRPILTFRAPRAQAVVGDLLELHCEALRGSSPILYWFYHEDVTL
GKISAPSGGGASFNLSLTTEHSGIYSCEADNGLEAQRSEMVTLKVAAAAEQKLISEEDLEQKLISEEDLE
QKLISEEDLTGVAGGLLSIAGLAAGALLLYCWLSRKAGRKPASDPARSPSDSDSQEPTYHNVPAWEELQP
VYTNANPRGENVVYSEVRIIQEKKKHAVASDPRHLRNKGSPIIYSEVKVASTPVSGSLFL
ASSAPHR*

>gi|14278719|gb|AAK50059.2|AF369794_1 B cell crosslinked IgM-activating sequence protein [Homo sapiens]

MLLWVILLVLAPVSGQFARTPRPIIFLQPPWTTVFQGERVTLTCKGFRFYSPQKTKWYHRYLGKEILRET
PDNILEVQESGEYRCQAQGSPLSSPVHLDFSSASLILQAPLSVFEGDSVVLRCRAKAEVTLNNTIYKNDN
VLAFLNKRTDFHIPHACLKDNGAYRCTGYKESCCPVSSNTVKIQVQEPFTRPVLRASSFQPISGNPVTLT
CETQLSLERSDVPLRFRFFRDDQTLGLGWSLSPNFQITAMWSKDSGFYWCKAATMPHSIISDSPRSWIQV
QIPASHPVLTLSPEKALNFEGTKVTLHCETQEDSLRTLYRFYHEGVPLRHKSVRCERGASISFSLTTENS
GNYYCTADNGLGAKPSKAVSLSVTVPVSHPVLNLSSPEDLIFEGAKVTLHCEAQRGSLPILYQFHHEDAA
LERRSANSAGGVAISFSLTAEHSGNYYCTADNGFGPQRSKAVSLSITVPVSHPVLTLSSAEALTFEGATV
TLHCEVQRGSPQILYQFYHEDMPLWSSSTPSVGRVSFSFSLTEGHSGNYYCTADNGFGPQRSEVVSLFVT
VPVSRPILTLRVPRAQAVVGDLLELHCEAPRGSPPILYWFYHEDVTLGSSSAPSGGEASFNLSLTAEHSG
NYSCEANNGLVAQHSDTISLSVIVPVSRPILTFRAPRAQAVVGDLLELHCEALRGSSPILYWFYHEDVTL
GKISAPSGGGASFNLSLTTEHSGIYSCEADNGPEAQRSEMVTLKVAVPVSRPVLTLRAPGTHAAVGDLLE
LHCEALRGSPLILYRFFHEDVTLGNRSSPSGGASLNLSLTAEHSGNYSCEADNGLGAQRSETVTLYITGL
TANRSGPFATGVAGGLLSIAGLAAGALLLYCWLSRKAGRKPASDPARSPPDSDSQEPTYHNVPAWEELQP
VYTNANPRGENVVYSEVRIIQEKKKHAVASDPRHLRNKGSPIIYSEVKVASTPVSGSLFLASSAPHR

FIG. 3C

| | |
|---|---|
| MSK_de1DOM9_myc3_mCD8 | MLLWVILLVLAPVSGQFARTPRPIIFLQPPWTTVFQGERVTLTCKGFRFYSPQKTKWYHR |
| gi\|14278719\|gb\|AAK50059.2\|AF3697 | MLLWVILLVLAPVSGQFARTPRPIIFLQPPWTTVFQGERVTLTCKGFRFYSPQKTKWYHR |

| | |
|---|---|
| MSK_de1DOM9_myc3_mCD8 | YLGKEILRETPDNILEVQESGEYRCQAQGSPLSSPVHLDFSSASLILQAPLSVFEGDSVV |
| gi\|14278719\|gb\|AAK50059.2\|AF3697 | YLGKEILRETPDNILEVQESGEYRCQAQGSPLSSPVHLDFSSASLILQAPLSVFEGDSVV |

| | |
|---|---|
| MSK_de1DOM9_myc3_mCD8 | LRCRAKAEVTLNNTIYKNDNVLAFLNKRTDFHIPHACLKDNGAYRCTGYKESCCPVSSMT |
| gi\|14278719\|gb\|AAK50059.2\|AF3697 | LRCRAKAEVTLNNTIYKNDNVLAFLNKRTDFHIPHACLKDNGAYRCTGYKESCCPVSSMT |

| | |
|---|---|
| MSK_de1DOM9_myc3_mCD8 | VKIQVQEPFTRPVLRASSFQPISGNPVTLTCETQLSLERSDVPLRFRFFRDDQTLGLGWS |
| gi\|14278719\|gb\|AAK50059.2\|AF3697 | VKIQVQEPFTRPVLRASSFQPISGNPVTLTCETQLSLERSDVPLRFRFFRDDQTLGLGWS |

| | |
|---|---|
| MSK_de1DOM9_myc3_mCD8 | LSPNFQITAMWSKDSGFYWCKAATMPHSIISDSPRSWIQVQIPASHPVLTLSPEKALNFE |
| gi\|14278719\|gb\|AAK50059.2\|AF3697 | LSPNFQITAMWSKDSGFYWCKAATMPHSVISDSPRSWIQVQIPASHPVLTLSPEKALNFE |

| | |
|---|---|
| MSK_de1DOM9_myc3_mCD8 | GTKVTLHCETQEDSLRTLYRFYHEGVPLRHKSVRCERGASISFSLTTENSGNYYCTADNG |
| gi\|14278719\|gb\|AAK50059.2\|AF3697 | GTKVTLHCETQEDSLRTLYRFYHEGVPLRHKSVRCERGASISFSLTTENSGNYYCTADNG |

| | |
|---|---|
| MSK_de1DOM9_myc3_mCD8 | LGAKPSKAVSLSVTVPVSHPVLNLSSPEDLIFEGAKVTLHCEAQRGSLPILYQFHHEDAA |
| gi\|14278719\|gb\|AAK50059.2\|AF3697 | LGAKPSKAVSLSVTVPVSHPVLNLSSPEDLIFEGAKVTLHCEAQRGSLPILYQFHHEDAA |

| | |
|---|---|
| MSK_de1DOM9_myc3_mCD8 | LERRSANSAGGVAISFSLTAEHSGNYYCTADNGFGPQRSKAVSLSITVPVSHPVLTLSSA |
| gi\|14278719\|gb\|AAK50059.2\|AF3697 | LERRSANSAGGVAISFSLTAEHSGNYYCTADNGFGPQRSKAVSLSITVPVSHPVLTLSSA |

FIG. 3D

| MSK_delDOM9_myc3_mCD8 | EALTFEGATVTLHCEVQRGSPQILYQFYHEDMPLWSSSTPSVGRVSFSFSLTEGHSGNYY |
| gi\|14278719\|gb\|AAK50059.2\|AF3697 | EALTFEGATVTLHCEVQRGSPQILYQFYHEDMPLWSSSTPSVGRVSFSFSLTEGHSGNYY |

| MSK_delDOM9_myc3_mCD8 | CTADNGFGPQRSEVVSLFVTVPVSRPILTLRVPRAQAVVGDLLELHCEAPRGSPPILYWF |
| gi\|14278719\|gb\|AAK50059.2\|AF3697 | CTADNGFGPQRSEVVSLFVTVPVSRPILTLRVPRAQAVVGDLLELHCEAPRGSPPILYWF |

| MSK_delDOM9_myc3_mCD8 | YHEDVTLGSSSAPSGGEASFNLSLTAEHSGNYSCEANNGLVAQHSDTISLSVIVPVSRPI |
| gi\|14278719\|gb\|AAK50059.2\|AF3697 | YHEDVTLGSSSAPSGGEASFNLSLTAEHSGNYSCEANNGLVAQHSDTISLSVIVPVSRPI |

| MSK_delDOM9_myc3_mCD8 | LTFRAPRAQAVVGDLLELHCEALRGSSPILYWFYHEDVTLGKISAPSGGGASFNLSLTTE |
| gi\|14278719\|gb\|AAK50059.2\|AF3697 | LTFRAPRAQAVVGDLLELHCEALRGSSPILYWFYHEDVTLGKISAPSGGGASFNLSLTTE |

| MSK_delDOM9_myc3_mCD8 | HSGIYSCEADNGiEAQRSEMVTLKVAqqqqQkLIS——————————————————————— |
| gi\|14278719\|gb\|AAK50059.2\|AF3697 | HSGIYSCEADNGpEAQRSEMVTLKVAvpvsRpVLTirapgthaavgdllelhcealrgsp |

| MSK_delDOM9_myc3_mCD8 | ——————————————eedLeqkLiSEedleqkliSEedL——————————————— |
| gi\|14278719\|gb\|AAK50059.2\|AF3697 | lilyrffhedvtlgnrsspsggasLnlsLtAEhsgnysceADngLgqqrsetvtlyitgl |

| MSK_delDOM9_myc3_mCD8 | ——————TGVAGGLLSIAGLAAGALLLYCWLSRKAGRKPASDPARSPsDSDSQEPTYH |
| gi\|14278719\|gb\|AAK50059.2\|AF3697 | tanrsgpfaTGVAGGLLSIAGLAAGALLLYCWLSRKAGRKPASDPARSPpDSDSQEPTYH |

| MSK_delDOM9_myc3_mCD8 | NVPAWEELQPVYTNANPRGENVVYSEVRIIQEKKKHAVASDPRHLRNKGSPIIYSEVKVA |
| gi\|14278719\|gb\|AAK50059.2\|AF3697 | NVPAWEELQPVYTNANPRGENVVYSEVRIIQEKKKHAVASDPRHLRNKGSPIIYSEVKVA |

| MSK_delDOM9_myc3_mCD8 | STPVSGSLFLASSAPHR |
| gi\|14278719\|gb\|AAK50059.2\|AF3697 | STPVSGSLFLASSAPHR |

| Sample Name | Median, PE-A |
|---|---|
| —— D05+Raji-FcRL5.fcs | 1.11E4 |
| — A04+Raji-FcRL5.fcs | 82.1 |

| Sample Name | Median, PE-A |
|---|---|
| —— D05+3T3-FcRL5.fcs | 3.76E4 |
| — A04+3T3-FcRL5.fcs | 1137 |

| Sample Name | Median, PE-A |
|---|---|
| —— D05+3T3-FcRL5-Delta.fcs | 496 |
| — A04+3T3-FcRL5-Delta.fcs | 162 |

| Sample Name | Median, PE-A |
|---|---|
| —— D05+NIH 3T3.fcs | 379 |
| — A04+NIH 3t3.fcs | 271 |

— Negative control phage
—— ET200 phage

ET200-104

— Negative control phage
— ET200 phage

ET200-105

— Negative control phage —— ET200 phage

ET200-109

| Sample Name | Median, PE-A |
|---|---|
| F04+Raji-FcRL5.fcs | 6161 |
| A04+Raji-FcRL5.fcs | 82.1 |

| Sample Name | Median, PE-A |
|---|---|
| F04+3T3-FcRL5.fcs | 1.75E4 |
| A04+3T3-FcRL5.fcs | 1137 |

| Sample Name | Median, PE-A |
|---|---|
| F04+3T3-FcRL5-Delta.fcs | 328 |
| A04+3T3-FcRL5-Delta.fcs | 162 |

| Sample Name | Median, PE-A |
|---|---|
| F04+NIH 3T3.fcs | 343 |
| A04+NIH 3T3.fcs | 271 |

—— Negative control phage    —— ET200 phage

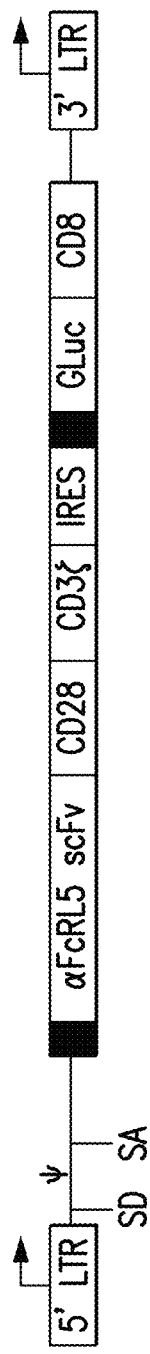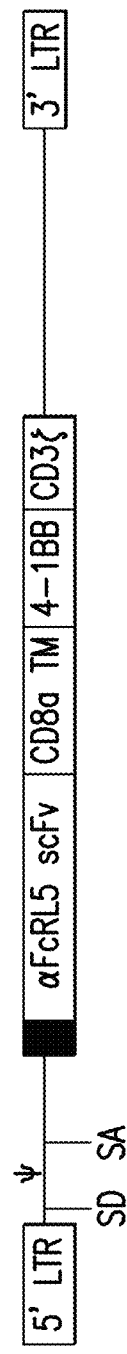
FIG. 9A
FIG. 9B

CHIMERIC ANTIGEN RECEPTORS TARGETING FC RECEPTOR-LIKE 5 AND USES THEREOF

CROSS-REFERENCE TO RELATED APPLICATIONS

This application is a continuation of International Application Serial No. PCT/US2015/064134, filed Dec. 4, 2015, which claims priority to U.S. Provisional Patent Application Ser. No. 62/088,164, filed Dec. 5, 2014, the contents of each of which are incorporated by reference in their entirety, and to each of which priority is claimed.

SEQUENCE LISTING

The specification further incorporates by reference the Sequence Listing submitted herewith via EFS on Jun. 5, 2017. Pursuant to 37 C.F.R. § 1.52 (e)(5), the Sequence Listing text file, identified as 0727340295CON_SL.txt, is 1,339,632 bytes and was created on Jun. 5, 2017. The Sequence Listing, electronically filed herewith, does not extend beyond the scope of the specification and thus does not contain new matter.

INTRODUCTION

The presently disclosed subject matter provides for methods and compositions for treating cancer. It relates to chimeric antigen receptors (CARs) that specifically target Fc Receptor-like 5 (FcRL5), e.g., domain 9 of FcRL5, immunoresponsive cells comprising such CARs, and methods of using such cells for treating cancer (e.g., multiple myeloma).

BACKGROUND OF THE INVENTION

Cell-based immunotherapy is a therapy with curative potential for the treatment of cancer. T cells and other immune cells may be modified to target tumor antigens through the introduction of genetic material coding for artificial or synthetic receptors for antigen, termed Chimeric Antigen Receptors (CARs), specific to selected antigens. Targeted T cell therapy using CARs has shown recent clinical success in treating hematologic malignancies.

Multiple myeloma (MM) is the second most common hematologic malignancy mortality (Siegel et al., *CA: a cancer journal for clinicians* 63, 11-30 (2013)). Approximately 25% of patients have high-risk cytogenetics, which portends a median survival of less then 2 years (Boyd et al., *Genes, chromosomes & cancer* 50, 765-774 (2011); Shaughnessy et al., *Blood* 109, 2276-2284 (2007)). While recent strides have been made, regardless of cytogenetics, the disease is still considered incurable outside the immunotherapeutic graft versus myeloma (GvM) effect of an allogeneic transplant. However, allogeneic transplants are limited by ineligibility and high rates of transplant-associated morbidity and mortality (Gahrton et al., *The New England journal of medicine* 325, 1267-1273 (1991)). Similar to the GvM effect, a potentially curative T cell effect may be achieved with minimal toxicity through autologous adoptive T cell therapy.

Myeloma is expected to be an ideal disease to test adoptive T cell therapy. First, allogeneic transplants demonstrate that the T cell can be a curative treatment, even with minimal or no concomitant chemotherapy such as after non-myeloablative transplants or post-transplantation donor lymphocyte infusions. Second, conditioning chemotherapy, possibly through the mechanism of depleting regulatory T cells (Tregs), enhances the efficacy of adoptive T cell therapy (Brentjens et al., *Blood* 118, 4817-4828 (2011) and Pegram et al., *Blood* 119, 4133-4141 (2012)) as such, the immediate post-autologous transplant period could be an optimal time to administer T cells, and myeloma is one of the few diseases where autologous stem cell transplantation is the standard of care. Third, the immunomodulatory drug lenalidomide may improve CAR based therapy, as has been shown in mice (Bertilaccio et al., *Blood* 122, 4171 (2013)), and lenalidomide is commonly used to treat MM. Fourth, adoptive T cell therapy works best in bone marrow predominant disease such as ALL (Brentjens et al., *Science translational medicine* 5, 177ra138 (2013); Davila et al., *Science translational medicine* 6, 224ra225 (2014)), when compared to solid tumors or extra-medullary CLL (Brentjens et al. (2011)) and similar to ALL, myeloma is a disease of the bone marrow.

While there are various reasons to expect that adoptive T cell therapy may work well in MM, expanding adoptive T cell therapy to myeloma poses unique challenges. Unlike other B-cell malignancies, CD19 expression is seen in only 2% of myeloma patients (Bataille et al., *Haematologica* 91, 1234-1240 (2006)). Furthermore, unlike CD19, the common extracellular immunophenotypic markers in myeloma (CD138, CD38, and CD56) are all co-expressed on other essential cell types, and CARs to any of these targets could lead to unacceptable "off tumor, on target" toxicity (Brentjens et al. (2013)) which can be fatal even in targets where antibodies are well tolerated, as was the case with a HER2 targeted CAR (Morgan et al., *Molecular therapy: the journal of the American Society of Gene Therapy* 18, 843-851 (2010)). Accordingly, there are needs for novel therapeutic strategies to design CARs targeting antigens that are highly expressed in MM cells and limited expression in normal tissues for treating multiple myeloma, which strategies capable of inducing potent tumor eradication with minimal toxicity and immunogenicity.

SUMMARY OF THE INVENTION

The presently disclosed subject matter generally provides chimeric antigen receptors (CARs) that specifically target Fc Receptor-like 5 (FcRL5), immunoresponsive cells comprising such CARs, and uses of these CARs and immunoresponsive cells for treating multiple myeloma.

The presently disclosed subject matter provides CARs. In one non-limiting example, the CAR comprises an extracellular antigen-binding domain, a transmembrane domain and an intracellular domain, where the extracellular antigen-binding domain specifically binds to FcRL5. In certain embodiments, the extracellular antigen-binding domain binds to domain 9 of FcRL5.

In certain non-limiting embodiments, the extracellular antigen-binding domain is a single-chain variable fragment (scFv). In certain embodiments, the extracellular antigen-binding domain is a murine scFv. In certain embodiments, the extracellular antigen-binding domain is a human scFv. In certain non-limiting embodiments, the extracellular antigen-binding domain is a Fab, which is optionally crosslinked. In certain non-limiting embodiments, the extracellular binding domain is a F(ab)$_2$. In certain non-limiting embodiments, any of the foregoing molecules can be comprised in a fusion protein with a heterologous sequence to form the extracellular antigen-binding domain. In certain embodiments, the extracellular antigen-binding domain specifically binds to FcRL5 with a binding affinity ($K_d$) of from about $1 \times 10^{-11}$ M to about 3×10⁻⁶M, 1×10⁻¹⁰ M to about 3×10⁻⁶ M or 1×10⁻⁹ M to about 3×10⁻⁶ M. In certain embodiments, the extracellular antigen-binding domain specifically binds to domain 8 or 9 of FcRL5 with a $K_d$ of from about 1×10⁻⁹M to about 3×10⁻⁶M.

In certain embodiments, the extracellular antigen-binding domain comprises a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299, SEQ ID NO:303, SEQ ID NO:917 and SEQ ID NO:921, wherein the extracellular antigen-binding domain binds to FcRL5.

In certain embodiments, the extracellular antigen-binding domain comprises a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300, SEQ ID NO:304, SEQ ID NO:915 and SEQ ID NO:919, wherein the extracellular antigen-binding domain binds to FcRL5.

In certain embodiments, the extracellular antigen-binding domain comprises (a) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299, SEQ ID NO:303, SEQ ID NO:917 and SEQ ID NO:921; and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300, SEQ ID NO:304, SEQ ID NO:915 and SEQ ID NO:919, wherein the extracellular antigen-binding domain binds to FcRL5.

In certain embodiments, the extracellular antigen-binding domain comprises a light chain variable region comprising an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299, SEQ ID NO:303, SEQ ID NO:917, SEQ ID NO:921 and conservative modifications thereof.

In certain embodiments, the extracellular antigen-binding domain comprises a heavy chain variable region comprising an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300, SEQ ID NO:304, SEQ ID NO:915, SEQ ID NO:919 and conservative modifications thereof.

In certain embodiments, the extracellular antigen-binding domain comprises a heavy chain variable region comprising amino acids having the sequence set forth in SEQ ID NO:915. In certain embodiments, the extracellular antigen-binding domain comprises a light chain variable region comprising amino acids having the sequence set forth in SEQ ID NO:917. In certain embodiments, the extracellular antigen-binding domain comprises a heavy chain variable region comprising amino acids having the sequence set forth in SEQ ID NO:919. In certain embodiments, the extracellular antigen-binding domain comprises a light chain variable region comprising amino acids having the sequence set forth in SEQ ID NO:921. In certain embodiments, the extracellular antigen-binding domain comprises a heavy chain variable region comprising amino acids having the sequence set forth in SEQ ID NO:144. In certain embodiments, the extracellular antigen-binding domain comprises a light chain variable region comprising amino acids having the sequence set forth in SEQ ID NO:143. In certain embodiments, the extracellular antigen-binding domain comprises a heavy chain variable region comprising amino acids having the sequence set forth in SEQ ID NO:216. In certain embodiments, the extracellular antigen-binding domain comprises a light chain variable region comprising amino acids having the sequence set forth in SEQ ID NO:215. In certain embodiments, the extracellular antigen-binding domain comprises a heavy chain variable region comprising amino acids having the sequence set forth in SEQ ID NO:220. In certain embodiments, the extracellular antigen-binding domain comprises a light chain variable region comprising amino acids having the sequence set forth in SEQ ID NO:219. In certain embodiments, the extracellular antigen-binding domain comprises a heavy chain variable region comprising amino acids having the sequence set forth in SEQ ID NO:236. In certain embodiments, the extracellular antigen-binding domain comprises a light chain variable region comprising amino acids having the sequence set forth in SEQ ID NO:235. In certain embodiments, the extracellular antigen-binding domain comprises a heavy chain variable region comprising amino acids having the sequence set forth in SEQ ID NO:268. In certain embodiments, the extracellular antigen-binding domain comprises a light chain variable region comprising amino acids having the sequence set forth in SEQ ID NO:267. In certain embodiments, the extracellular antigen-binding domain comprises a heavy chain variable region comprising amino acids having the sequence set forth in SEQ ID NO:116. In certain embodiments, the extracellular antigen-binding domain comprises a light chain variable region comprising amino acids having the sequence set forth in SEQ ID NO:115. In certain embodiments, the extracellular antigen-binding domain comprises a heavy chain variable region comprising amino acids having the sequence set forth in SEQ ID NO:172. In certain embodiments, the extracellular antigen-binding domain comprises a light chain variable region comprising amino acids having the sequence set forth in SEQ ID NO:171.

In certain embodiments, the extracellular antigen-binding domain comprises (a) a light chain variable region comprising an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299, SEQ ID NO:303, SEQ ID NO:917, SEQ ID NO:921 and conservative modifications thereof; and (b) a heavy chain variable region comprising an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300, SEQ ID NO:304, SEQ ID NO:915, SEQ ID NO:919 and conservative modifications thereof.

In certain embodiments, the extracellular antigen-binding domain comprises (a) a heavy chain variable region comprising amino acids having the sequence set forth in SEQ ID NO:915; and (b) a light chain variable region comprising amino acids having the sequence set forth in SEQ ID NO:917. In certain embodiments, the extracellular antigen-binding domain comprises extracellular antigen-binding domain comprises (a) a heavy chain variable region comprising amino acids having the sequence set forth in SEQ ID NO:919; and (b) a light chain variable region comprising amino acids having the sequence set forth in SEQ ID NO:921. In certain embodiments, the extracellular antigen-binding domain comprises (a) a heavy chain variable region comprising amino acids having the sequence set forth in SEQ ID NO:144, and (b) a light chain variable region comprising amino acids having the sequence set forth in SEQ ID NO:143. In certain embodiments, the extracellular antigen-binding domain comprises (a) a heavy chain variable region comprising amino acids having the sequence set forth in SEQ ID NO:216, and (b) a light chain variable region comprising amino acids having the sequence set forth in SEQ ID NO:215. In certain embodiments, the extracellular antigen-binding domain comprises (a) a heavy chain variable region comprising amino acids having the sequence set forth in SEQ ID NO:220, and (b) a light chain variable region comprising amino acids having the sequence set forth in SEQ ID NO:219. In certain embodiments, the extracellular antigen-binding domain comprises (a) a heavy chain variable region comprising amino acids having the sequence set forth in SEQ ID NO:236, and (b) a light chain variable region comprising amino acids having the sequence set forth in SEQ ID NO:235. In certain embodiments, the extracellular antigen-binding domain comprises (a) a heavy chain variable region comprising amino acids having the sequence set forth in SEQ ID NO:268, and (b) a light chain variable region comprising amino acids having the sequence set forth in SEQ ID NO:267. In certain embodiments, the extracellular antigen-binding domain comprises (a) a heavy chain variable region comprising amino acids having the sequence set forth in SEQ ID NO:116, and (b) a light chain variable region comprising amino acids having the sequence set forth in SEQ ID NO:115. In certain embodiments, the extracellular antigen-binding domain comprises (a) a heavy chain variable region comprising amino acids having the sequence set forth in SEQ ID NO:172, and (b) a light chain variable region comprising amino acids having the sequence set forth in SEQ ID NO:171.

In certain non-limiting embodiments, the extracellular antigen-binding domain comprises both of said heavy and light chains, optionally with a linker sequence, for example a linker peptide, between the heavy chain variable region and the light chain variable region. For example, in certain non-limiting embodiments, the extracellular antigen-binding domain comprises (a) a heavy chain variable region comprising amino acids having the sequence set forth in SEQ ID NO:915, and (b) a light chain variable region comprising amino acids having the sequence set forth in SEQ ID NO:917, optionally with (c) a linker sequence, for example a linker peptide, between the heavy chain variable region and the light chain variable region. In certain embodiments, the extracellular antigen-binding domain comprises (a) a heavy chain variable region comprising amino acids having the sequence set forth in SEQ ID NO:919 and (b) a light chain variable region comprising amino acids having the sequence set forth in SEQ ID NO:92, optionally with (c) a linker sequence, for example a linker peptide, between the heavy chain variable region and the light chain variable region. In certain embodiments, the extracellular antigen-binding domain comprises (a) a heavy chain variable region comprising amino acids having the sequence set forth in SEQ ID NO:144 and (b) a light chain variable region comprising amino acids having the sequence set forth in SEQ ID NO:143, optionally with (c) a linker sequence, for example a linker peptide, between the heavy chain variable region and the light chain variable region. In certain embodiments, the extracellular antigen-binding domain comprises (a) a heavy chain variable region comprising amino acids having the sequence set forth in SEQ ID NO:216 and (b) a light chain variable region comprising amino acids having the sequence set forth in SEQ ID NO:215, optionally with (c) a linker sequence, for example a linker peptide, between the heavy chain variable region and the light chain variable region. In certain embodiments, the extracellular antigen-binding domain comprises (a) a heavy chain variable region comprising amino acids having the sequence set forth in SEQ ID NO:220 and (b) a light chain variable region comprising amino acids having the sequence set forth in SEQ ID NO:219, optionally with (c) a linker sequence, for example a linker peptide, between the heavy chain variable region and the light chain variable region. In certain embodiments, the extracellular antigen-binding domain comprises (a) a heavy chain variable region comprising amino acids having the sequence set forth in SEQ ID NO:236 and (b) a light chain variable region comprising amino acids having the sequence set forth in SEQ ID NO:235, optionally with (c) a linker sequence, for example a linker peptide, between the heavy chain variable region and the light chain variable region. In certain embodiments, the extracellular antigen-binding domain comprises (a) a heavy chain variable region comprising amino acids having the sequence set forth in SEQ ID NO:268 and (b) a light chain variable region comprising amino acids having the sequence set forth in SEQ ID NO:267, optionally with (c) a linker sequence, for example a linker peptide, between the heavy chain variable region and the light chain variable region. In certain embodiments, the extracellular antigen-binding domain comprises (a) a heavy chain variable region comprising amino acids having the sequence set forth in SEQ ID NO:116 and (b) a light chain variable region comprising amino acids having the sequence set forth in SEQ ID NO:115, optionally with (c) a linker sequence, for example a linker peptide, between the heavy chain variable region and the light chain variable region. In certain embodiments, the extracellular antigen-binding domain comprises (a) a heavy chain variable region comprising amino acids having the sequence set forth in SEQ ID NO:172 and (b) a light chain variable region comprising amino acids having the sequence set forth in SEQ ID NO:171, optionally with (c) a linker sequence, for example a linker peptide, between the heavy chain variable region and the light chain variable region.

In certain embodiments, the extracellular antigen-binding domain comprises (a) a heavy chain variable region CDR3 comprising an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587, 591, 925 and 931; and (b) a light chain variable region CDR3 comprising an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581, 592, 928 and 934.

In certain embodiments, the extracellular antigen-binding domain comprises: (a) a heavy chain variable region CDR1 comprising an amino acid sequence selected from the group consisting of SEQ ID NOs: 309, 315, 321, 326, 332, 335, 340, 346, 354, 360, 366, 372, 378, 387, 393, 403, 411, 420, 425, 436, 440, 444, 471, 480, 500, 510, 515, 520, 525, 537, 551, 559, 565, 582, 589, 923 and 929; (b) a heavy chain variable region CDR2 comprising an amino acid sequence selected from the group consisting of SEQ ID NOs: 310, 316, 322, 327, 333, 336, 341, 355, 361, 367, 373, 379, 388, 404, 412, 421, 426, 431, 441, 445, 450, 466, 472, 475, 481, 496, 501, 506, 511, 516, 521, 526, 538, 552, 560, 566, 583, 590, 924 and 930; (c) a heavy chain variable region CDR3 comprising an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587, 591, 925 and 931; (d) a light chain variable region CDR1 comprising an amino acid sequence selected from the group consisting of SEQ ID NOs: 312, 318, 324, 329, 338, 343, 348, 352, 357, 363, 369, 381, 390, 397, 401, 406, 416, 423, 428, 433, 447, 460, 468, 474, 477, 483, 490, 498, 503, 508, 518, 533, 540, 544, 547, 556, 562, 568, 571, 580, 585, 588, 926 and 932; (e) a light chain variable region CDR2 comprising an amino acid sequence selected from the group consisting of SEQ ID NOs: 313, 319, 330, 344, 349, 358, 364, 370, 382, 385, 391, 398, 409, 417, 429, 434, 438, 448, 454, 461, 469, 478, 484, 487, 504, 513, 523, 534, 429, 448, 548, 557, 563, 572, 575, 586, 927 and 933; and (f) a light chain variable region CDR3 comprising an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581, 592, 928 and 934.

In certain embodiments, the extracellular antigen-binding domain comprises (a) a heavy chain variable region CDR1 comprising amino acids having the sequence set forth in SEQ ID NO:923 or conservative modifications thereof, (b) a heavy chain variable region CDR2 comprising amino acids having the sequence set forth in SEQ ID NO:924 or conservative modifications thereof, and (c) a heavy chain variable region CDR3 comprising amino acids having the sequence set forth in SEQ ID NO:925 or conservative modifications thereof. In certain embodiments, the extracellular antigen-binding domain comprises (a) a light chain variable region CDR1 comprising amino acids having the sequence set forth in SEQ ID NO:926 or conservative modifications thereof, (b) a light chain variable region CDR2 comprising amino acids having the sequence set forth in SEQ ID NO:927 or conservative modifications thereof, and (c) a light chain variable region CDR3 comprising amino acids having the sequence set forth in SEQ ID NO:928 or conservative modifications thereof.

In certain embodiments, the extracellular antigen-binding domain comprises (a) a heavy chain variable region CDR1 comprising amino acids having the sequence set forth in SEQ ID NO:929 or conservative modifications thereof, (b) a heavy chain variable region CDR2 comprising amino acids having the sequence set forth in SEQ ID NO:930 or conservative modifications thereof, and (c) a heavy chain variable region CDR3 comprising amino acids having the sequence set forth in SEQ ID NO:931 or conservative modifications thereof. In certain embodiments, the extracellular antigen-binding domain comprises (a) a light chain variable region CDR1 comprising amino acids having the sequence set forth in SEQ ID NO:932 or conservative modifications thereof, (b) a light chain variable region CDR2 comprising amino acids having the sequence set forth in SEQ ID NO:933 or conservative modifications thereof, and (c) a light chain variable region CDR3 comprising amino acids having the sequence set forth in SEQ ID NO:934 or conservative modifications thereof.

In certain embodiments, the extracellular antigen-binding domain comprises: (a) a heavy chain variable region CDR1 comprising amino acids having the sequence set forth in SEQ ID NO:923 or conservative modifications thereof, (b) a heavy chain variable region CDR2 comprising amino acids having the sequence set forth in SEQ ID NO:924 or conservative modifications thereof, (c) a heavy chain variable region CDR3 comprising amino acids having the sequence set forth in SEQ ID NO:925 or conservative modifications thereof, (d) a light chain variable region CDR1 comprising amino acids having the sequence set forth in SEQ ID NO:926 or conservative modifications thereof, (e) a light chain variable region CDR2 comprising amino acids having the sequence set forth in SEQ ID NO:927 or conservative modifications thereof, and (f) a light chain variable region CDR3 comprising amino acids having the sequence set forth in SEQ ID NO:928 or conservative modifications thereof.

In certain embodiments, the extracellular antigen-binding domain comprises: (a) a heavy chain variable region CDR1 comprising amino acids having the sequence set forth in SEQ ID NO:929 or conservative modifications thereof, (b) a heavy chain variable region CDR2 comprising amino acids having the sequence set forth in SEQ ID NO:930 or conservative modifications thereof, (c) a heavy chain variable region CDR3 comprising amino acids having the sequence set forth in SEQ ID NO:931 or conservative modifications thereof, (d) a light chain variable region CDR1 comprising amino acids having the sequence set forth in SEQ ID NO:932 or conservative modifications thereof, (e) a light chain variable region CDR2 comprising amino acids having the sequence set forth in SEQ ID NO:933 or conservative modifications thereof, and (f) a light chain variable region CDR3 comprising amino acids having the sequence set forth in SEQ ID NO:934 or conservative modifications thereof.

In certain embodiments, the extracellular antigen-binding domain comprises: (a) a heavy chain variable region CDR1 comprising the amino acid sequence of SEQ ID NO:411 or conservative modifications thereof; (b) a heavy chain variable region CDR2 comprising the amino acid sequence of SEQ ID NO:412 or conservative modifications thereof; (c) a heavy chain variable region CDR3 comprising the amino acid sequence of SEQ ID NO:463 or conservative modifications thereof; (d) a light chain variable region CDR1 comprising the amino acid sequence of SEQ ID NO:318 or conservative modifications thereof; (e) a light chain variable region CDR2 comprising the amino acid sequence of SEQ ID NO:319 or conservative modifications thereof; and (f) a light chain variable region CDR3 comprising the amino acid sequence of SEQ ID NO:419 or conservative modifications thereof.

In certain embodiments, the extracellular antigen-binding domain comprises: (a) a heavy chain variable region CDR1 comprising the amino acid sequence of SEQ ID NO:515 or conservative modifications thereof; (b) a heavy chain variable region CDR2 comprising the amino acid sequence of SEQ ID NO:516 or conservative modifications thereof; (c) a heavy chain variable region CDR3 comprising the amino acid sequence of SEQ ID NO:517 or conservative modifications thereof; (d) a light chain variable region CDR1 comprising the amino acid sequence of SEQ ID NO:318 or conservative modifications thereof; (e) a light chain variable region CDR2 comprising the amino acid sequence of SEQ ID NO:319 or conservative modifications thereof; and (f) a light chain variable region CDR3 comprising the amino acid sequence of SEQ ID NO:531 or conservative modifications thereof.

In certain embodiments, the extracellular antigen-binding comprises: (a) a heavy chain variable region CDR1 comprising the amino acid sequence of SEQ ID NO:403 or conservative modifications thereof; (b) a heavy chain variable region CDR2 comprising the amino acid sequence of SEQ ID NO:404 or conservative modifications thereof; (c) a heavy chain variable region CDR3 comprising the amino acid sequence of SEQ ID NO:532 or conservative modifications thereof; (d) a light chain variable region CDR1 comprising the amino acid sequence of SEQ ID NO:533 or conservative modifications thereof; (e) a light chain variable region CDR2 comprising the amino acid sequence of SEQ ID NO:534 or conservative modifications thereof; and (f) a light chain variable region CDR3 comprising the amino acid sequence of SEQ ID NO:535.

In certain embodiments, the extracellular antigen-binding domain comprises: (a) a heavy chain variable region CDR1 comprising the amino acid sequence of SEQ ID NO:411 or conservative modifications thereof; (b) a heavy chain variable region CDR2 comprising the amino acid sequence of SEQ ID NO:412 or conservative modifications thereof; (c) a heavy chain variable region CDR3 comprising the amino acid sequence of SEQ ID NO:543 or conservative modifications thereof; (d) a light chain variable region CDR1 comprising the amino acid sequence of SEQ ID NO:544 or conservative modifications thereof; (e) a light chain variable region CDR2 comprising the amino acid sequence of SEQ ID NO:448 or conservative modifications thereof; and (f) a light chain variable region CDR3 comprising the amino acid sequence of SEQ ID NO:545 or conservative modifications thereof.

In certain embodiments, the extracellular antigen-binding domain comprises: (a) a heavy chain variable region CDR1 comprising the amino acid sequence of SEQ ID NO:372 or conservative modifications thereof; (b) a heavy chain variable region CDR2 comprising the amino acid sequence of SEQ ID NO:475 or conservative modifications thereof; (c) a heavy chain variable region CDR3 comprising the amino acid sequence of SEQ ID NO:570 or conservative modifications thereof; (d) a light chain variable region CDR1 comprising the amino acid sequence of SEQ ID NO:571 thereof; (e) a light chain variable region CDR2 comprising the amino acid sequence of SEQ ID NO:572 or conservative modifications thereof; and (f) a light chain variable region CDR3 comprising the amino acid sequence of SEQ ID NO:573 or conservative modifications thereof.

In certain embodiments, the extracellular antigen-binding domain comprises: (a) a heavy chain variable region CDR1 comprising the amino acid sequence of SEQ ID NO:440 or conservative modifications thereof; (b) a heavy chain variable region CDR2 comprising the amino acid sequence of SEQ ID NO:441 or conservative modifications thereof; (c) a heavy chain variable region CDR3 comprising the amino acid sequence of SEQ ID NO:442 or conservative modifications thereof; (d) a light chain variable region CDR1 comprising the amino acid sequence of SEQ ID NO:329 or conservative modifications thereof; (e) a light chain variable region CDR2 comprising the amino acid sequence of SEQ ID NO:330 or conservative modifications thereof; and (f) a light chain variable region CDR3 comprising the amino acid sequence of SEQ ID NO:443 or conservative modifications thereof.

In certain embodiments, the extracellular antigen-binding domain comprises: (a) a heavy chain variable region CDR1 comprising the amino acid sequence of SEQ ID NO:309 or conservative modifications thereof; (b) a heavy chain variable region CDR2 comprising the amino acid sequence of SEQ ID NO:310 or conservative modifications thereof; (c) a heavy chain variable region CDR3 comprising the amino acid sequence of SEQ ID NO:489 or conservative modifications thereof; (d) a light chain variable region CDR1 comprising the amino acid sequence of SEQ ID NO:490 or conservative modifications thereof; (e) a light chain variable region CDR2 comprising the amino acid sequence of SEQ ID NO:313 or conservative modifications thereof; and (f) a light chain variable region CDR3 comprising the amino acid sequence of SEQ ID NO:491 or conservative modifications thereof.

In certain non-limiting embodiments, the extracellular antigen-binding domain comprises amino acids having the sequence set forth in SEQ ID NO:664 or conservative modifications thereof. In certain embodiments, the extracellular antigen-binding domain comprises amino acids having the sequence set forth in SEQ ID NO:700 or conservative modifications thereof. In certain embodiments, the extracellular antigen-binding domain comprises amino acids having the sequence set forth in SEQ ID NO:702 or conservative modifications thereof. In certain embodiments, the extracellular antigen-binding domain comprises amino acids having the sequence set forth in SEQ ID NO:710 or conservative modifications thereof. In certain embodiments, the extracellular antigen-binding domain comprises amino acids having the sequence set forth in SEQ ID NO:726 or conservative modifications thereof. In certain embodiments, the extracellular antigen-binding domain comprises amino acids having the sequence set forth in SEQ ID NO:650 or conservative modifications thereof. In certain embodiments, the extracellular antigen-binding domain comprises amino acids having the sequence set forth in SEQ ID NO:678 or conservative modifications thereof.

In certain non-limiting embodiments, the extracellular antigen-binding domain comprises (a) a heavy chain variable region CDR1 comprising amino acids having the sequence set forth in SEQ ID NO:923 or conservative modifications thereof, a heavy chain variable region CDR2 comprising amino acids having the sequence set forth in SEQ ID NO:924 or conservative modifications thereof, and a heavy chain variable region CDR3 comprising amino acids having the sequence set forth in SEQ ID NO:925 or conservative modifications thereof, and (ii) a light chain variable region CDR1 comprising amino acids having the sequence set forth in SEQ ID NO:926 or conservative modifications thereof, a light chain variable region CDR2 comprising amino acids having the sequence set forth in SEQ ID NO:927 or conservative modifications thereof, and a light chain variable region CDR3 comprising amino acids having the sequence set forth in SEQ ID NO:928 or conservative modifications thereof, optionally with (iii) a linker sequence, for example a linker peptide, between the heavy chain variable region and the light chain variable region.

In another non-limiting embodiment, the extracellular antigen-binding domain comprises (i) a heavy chain variable region CDR1 comprising amino acids having the sequence set forth in SEQ ID NO:929 or conservative modifications thereof, a heavy chain variable region CDR2 comprising amino acids having the sequence set forth in SEQ ID NO:930 or conservative modifications thereof, and a heavy chain variable region CDR3 comprising amino acids having the sequence set forth in SEQ ID NO:931 or conservative modifications thereof, and (ii) a light chain variable region CDR1 comprising amino acids having the sequence set forth in SEQ ID NO:932 or conservative modifications thereof, a light chain variable region CDR2 comprising amino acids having the sequence set forth in SEQ ID NO:933 or conservative modifications thereof, and a light chain variable region CDR3 comprising amino acids having the sequence set forth in SEQ ID NO:934 or conservative modifications thereof, optionally with (iii) a linker sequence, for example a linker peptide, between the heavy chain variable region and the light chain variable region.

In certain embodiments, the extracellular antigen-binding domain comprises: (a) a heavy chain variable region CDR1 comprising the amino acid sequence of SEQ ID NO:411 or conservative modifications thereof; (b) a heavy chain variable region CDR2 comprising the amino acid sequence of SEQ ID NO:412 or conservative modifications thereof; (c) a heavy chain variable region CDR3 comprising the amino acid sequence of SEQ ID NO:463 or conservative modifications thereof; (d) a light chain variable region CDR1 comprising the amino acid sequence of SEQ ID NO:318 or conservative modifications thereof; (e) a light chain variable region CDR2 comprising the amino acid sequence of SEQ ID NO:319 or conservative modifications thereof; and (f) a light chain variable region CDR3 comprising the amino acid sequence of SEQ ID NO:419 or conservative modifications thereof, optionally with (g) a linker sequence, for example a linker peptide, between the heavy chain variable region and the light chain variable region.

In certain embodiments, the extracellular antigen-binding domain comprises: (a) a heavy chain variable region CDR1 comprising the amino acid sequence of SEQ ID NO:515 or conservative modifications thereof; (b) a heavy chain variable region CDR2 comprising the amino acid sequence of SEQ ID NO:516 or conservative modifications thereof; (c) a heavy chain variable region CDR3 comprising the amino acid sequence of SEQ ID NO:517 or conservative modifications thereof; (d) a light chain variable region CDR1 comprising the amino acid sequence of SEQ ID NO:318 or conservative modifications thereof; (e) a light chain variable region CDR2 comprising the amino acid sequence of SEQ ID NO:319 or conservative modifications thereof; and (f) a light chain variable region CDR3 comprising the amino acid sequence of SEQ ID NO:531 or conservative modifications thereof, optionally with (g) a linker sequence, for example a linker peptide, between the heavy chain variable region and the light chain variable region.

In certain embodiments, the extracellular antigen-binding comprises: (a) a heavy chain variable region CDR1 comprising the amino acid sequence of SEQ ID NO:403 or conservative modifications thereof; (b) a heavy chain variable region CDR2 comprising the amino acid sequence of SEQ ID NO:404 or conservative modifications thereof; (c) a heavy chain variable region CDR3 comprising the amino acid sequence of SEQ ID NO:532 or conservative modifications thereof; (d) a light chain variable region CDR1 comprising the amino acid sequence of SEQ ID NO:533 or conservative modifications thereof; (e) a light chain variable region CDR2 comprising the amino acid sequence of SEQ ID NO:534 or conservative modifications thereof; and (f) a light chain variable region CDR3 comprising the amino acid sequence of SEQ ID NO:535, optionally with (g) a linker sequence, for example a linker peptide, between the heavy chain variable region and the light chain variable region.

In certain embodiments, the extracellular antigen-binding domain comprises: (a) a heavy chain variable region CDR1 comprising the amino acid sequence of SEQ ID NO:411 or conservative modifications thereof; (b) a heavy chain variable region CDR2 comprising the amino acid sequence of SEQ ID NO:412 or conservative modifications thereof; (c) a heavy chain variable region CDR3 comprising the amino acid sequence of SEQ ID NO:543 or conservative modifications thereof; (d) a light chain variable region CDR1 comprising the amino acid sequence of SEQ ID NO:544 or conservative modifications thereof; (e) a light chain variable region CDR2 comprising the amino acid sequence of SEQ ID NO:448 or conservative modifications thereof; and (f) a light chain variable region CDR3 comprising the amino acid sequence of SEQ ID NO:545 or conservative modifications thereof, optionally with (g) a linker sequence, for example a linker peptide, between the heavy chain variable region and the light chain variable region.

In certain embodiments, the extracellular antigen-binding domain comprises: (a) a heavy chain variable region CDR1 comprising the amino acid sequence of SEQ ID NO:372 or conservative modifications thereof; (b) a heavy chain variable region CDR2 comprising the amino acid sequence of SEQ ID NO:475 or conservative modifications thereof; (c) a heavy chain variable region CDR3 comprising the amino acid sequence of SEQ ID NO:570 or conservative modifications thereof; (d) a light chain variable region CDR1 comprising the amino acid sequence of SEQ ID NO:571 or conservative modifications thereof; (e) a light chain variable region CDR2 comprising the amino acid sequence of SEQ ID NO:572 or conservative modifications thereof; and (f) a light chain variable region CDR3 comprising the amino acid sequence of SEQ ID NO:573 or conservative modifications thereof, optionally with (g) a linker sequence, for example a linker peptide, between the heavy chain variable region and the light chain variable region.

In certain embodiments, the extracellular antigen-binding domain comprises: (a) a heavy chain variable region CDR1 comprising the amino acid sequence of SEQ ID NO:440 or conservative modifications thereof; (b) a heavy chain variable region CDR2 comprising the amino acid sequence of SEQ ID NO:441 or conservative modifications thereof; (c) a heavy chain variable region CDR3 comprising the amino acid sequence of SEQ ID NO:442 or conservative modifications thereof; (d) a light chain variable region CDR1 comprising the amino acid sequence of SEQ ID NO:329 or conservative modifications thereof; (e) a light chain variable region CDR2 comprising the amino acid sequence of SEQ ID NO:330 or conservative modifications thereof; and (f) a light chain variable region CDR3 comprising the amino acid sequence of SEQ ID NO:443 or conservative modifications thereof, optionally with (g) a linker sequence, for example a linker peptide, between the heavy chain variable region and the light chain variable region.

In certain embodiments, the extracellular antigen-binding domain comprises: (a) a heavy chain variable region CDR1 comprising the amino acid sequence of SEQ ID NO:309 or conservative modifications thereof; (b) a heavy chain variable region CDR2 comprising the amino acid sequence of SEQ ID NO:310 or conservative modifications thereof; (c) a heavy chain variable region CDR3 comprising the amino acid sequence of SEQ ID NO:489 or conservative modifications thereof; (d) a light chain variable region CDR1 comprising the amino acid sequence of SEQ ID NO:490 or conservative modifications thereof; (e) a light chain variable region CDR2 comprising the amino acid sequence of SEQ ID NO:313 or conservative modifications thereof; and (f) a light chain variable region CDR3 comprising the amino acid sequence of SEQ ID NO:491 or conservative modifications thereof, optionally with (g) a linker sequence, for example a linker peptide, between the heavy chain variable region and the light chain variable region.

In certain embodiments, the linker peptide comprises an amino acid sequence selected from the group consisting of SEQ ID NO:307 and SEQ ID NO:897.

In certain embodiments, the extracellular antigen-binding domain binds to FcRL5 comprising the amino acid sequence set forth in SEQ ID NO:899. In certain embodiments, the extracellular antigen-binding domain binds to an epitope comprising the amino acid sequence set forth in SEQ ID NO:964. In certain embodiments, the extracellular antigen-binding domain binds to an epitope comprising the amino acid sequence set forth in SEQ ID NO:965.

In accordance with the presently disclosed subject matter, the extracellular antigen-binding domain is covalently joined to a transmembrane domain. The extracellular antigen-binding domain can comprise a signal peptide that is covalently joined to the 5' terminus of the extracellular antigen-binding domain. In certain embodiments, the transmembrane domain of the CAR comprises a CD8 polypeptide, a CD28 polypeptide, a CD3ζ polypeptide, a CD4 polypeptide, a 4-1BB polypeptide, an OX40 polypeptide, an ICOS polypeptide, a CTLA-4 polypeptide, a PD-1 polypeptide, a LAG-3 polypeptide, a 2B4 polypeptide, a BTLA polypeptide, a synthetic peptide (not based on a protein associated with the immune response), or a combination thereof. In a non-limiting embodiment, the transmembrane domain comprises a CD8 polypeptide. In certain embodiments, the transmembrane domain comprises a CD28 polypeptide.

In accordance with the presently disclosed subject matter, in certain embodiments, the intracellular domain comprises a CD3ζ polypeptide. In certain embodiments, the intracellular domain further comprises at least one signaling region. In certain embodiments, the at least one signaling region comprises a CD28 polypeptide, a 4-1BB polypeptide, an OX40 polypeptide, an ICOS polypeptide, a DAP-10 polypeptide, a PD-1 polypeptide, a CTLA-4 polypeptide, a LAG-3 polypeptide, a 2B4 polypeptide, a BTLA polypeptide, a synthetic peptide (not based on a protein associated with the immune response), or a combination thereof. In certain embodiments, the signaling region is a co-stimulatory signaling region. In certain embodiments, the co-stimulatory signaling region comprises a CD28 polypeptide, a 4-1BB polypeptide, an OX40 polypeptide, an ICOS polypeptide, a DAP-10 polypeptide, or a combination thereof. In certain embodiments, the at least one co-stimulatory signaling region comprises a CD28 polypeptide. In certain non-limiting embodiments, the transmembrane domain comprises a CD28 polypeptide, the intracellular domain comprises a CD3ζ polypeptide, and the co-stimulatory signaling domain comprises a CD28 polypeptide. In certain non-limiting embodiments, the transmembrane domain comprises a CD8 polypeptide, the intracellular domain comprises a CD3ζ polypeptide, and the co-stimulatory signaling domain comprises a 4-1BB polypeptide.

In certain embodiments, the CAR is recombinantly expressed. The CAR can be expressed from a vector. In certain embodiments, the vector is a γ-retroviral rector.

The presently disclosed subject matter also provides isolated immunoresponsive cells comprising the above-described CARs. In certain embodiments, the isolated immunoresponsive cell is transduced with the CAR, for example, the CAR is constitutively expressed on the surface of the immunoresponsive cell. In certain embodiments, the isolated immunoresponsive cell is further transduced with at least one co-stimulatory ligand such that the immunoresponsive cell expresses the at least one co-stimulatory ligand. In certain embodiments, the at least one co-stimulatory ligand is selected from the group consisting of 4-1BBL, CD80, CD86, CD70, OX40L, CD48, TNFRSF14, and combinations thereof. In certain embodiments, the isolated immunoresponsive cell is further transduced with at least one cytokine such that the immunoresponsive cell secrets the at least one cytokine. In certain embodiments, the at least one cytokine is selected from the group consisting of IL-2, IL-3, IL-6, IL-7, IL-11, IL-12, IL-15, IL-17, IL-21, and combinations thereof. In certain embodiments, the isolated immunoresponsive cell is selected from the group consisting of a T cell, a Natural Killer (NK) cell, a cytotoxic T lymphocyte (CTL), a regulatory T cell, a human embryonic stem cell, a lymphoid progenitor cell, a T cell-precursor cell, and a pluripotent stem cell from which lymphoid cells may be differentiated. In certain embodiments, the immunoresponsive cell is a T cell.

The presently disclosed subject matter further provides nucleic acid molecules encoding the presently disclosed CARs, vectors comprising the nucleic acid molecules, and host cells expressing such nucleic acid molecules. In certain embodiments, the nucleic acid molecule comprises nucleic acids having the sequence set forth in SEQ ID NO:951. In certain embodiments, the nucleic acid molecule comprises nucleic acids having the sequence set forth in SEQ ID NO:952. In certain embodiments, the vector is a γ-retroviral vector. In certain embodiments, the host cell is a T cell.

Furthermore, the presently disclosed subject matter provides methods of using the above-described immunoresponsive cell for reducing tumor burden in a subject. For example, the presently disclosed subject matter provides methods of reducing tumor burden in a subject, where the method comprises administering an effective amount of the presently disclosed immunoresponsive cell to the subject, thereby inducing tumor cell death in the subject. In certain embodiments, the method reduces the number of tumor cells. In another embodiment, the method reduces the tumor size. In yet another embodiment, the method eradicates the tumor in the subject. In certain embodiments, the tumor is selected from the group consisting of multiple myeloma, Non-Hodgkin Lymphoma (especially Mantle Cell), Hodgkin Lymphoma, Chronic Lymphocytic Leukemia (CLL), Acute lymphocytic leukemia (ALL), Hairy Cell Leukemia, Burketts Lymphoma, and Waldenstrom's Macroglobulinemia. In certain embodiments, the tumor is multiple myeloma. In certain embodiments, the subject is a human. In certain embodiments, the immunoresponsive cell is a T cell.

Furthermore, the presently disclosed subject matter provides methods of using the above-described immunoresponsive cell for increasing or lengthening survival of a subject having neoplasia. For example, the presently disclosed subject matter provides methods of increasing or lengthening survival of a subject having neoplasia, where the method comprises administering an effective amount of the presently disclosed immunoresponsive cell to the subject, thereby increasing or lengthening survival of the subject. In certain embodiments, the neoplasia is selected from the group consisting of multiple myeloma, Non-Hodgkin Lymphoma (especially Mantle Cell), Hodgkin Lymphoma, Chronic Lymphocytic Leukemia (CLL), Acute lymphocytic leukemia (ALL), Hairy Cell Leukemia, Burketts Lymphoma, and Waldenstrom's Macroglobulinemia. In certain embodiments, the neoplasia is multiple myeloma. In certain embodiments, the method reduces or eradicates tumor burden in the subject. The presently disclosed subject matter also provides methods for producing an immunoresponsive cell that binds to Fc Receptor-like 5 (FcRL5), e.g., domain 9 of FcRL5. In one non-limiting example, the method comprises introducing into the immunoresponsive cell a nucleic acid sequence that encodes a chimeric antigen receptor (CAR), which comprises an extracellular antigen-binding domain, a transmembrane domain and an intracellular domain, wherein the extracellular antigen-binding domain specifically binds to Fc Receptor-like 5 (FcRL5). In a specific non-limiting embodiment, the extracellular antigen-binding domain is an scFv.

The presently disclosed subject matter further provides pharmaceutical compositions comprising an effective amount of the presently disclosed immunoresponsive cells and a pharmaceutically acceptable excipient. In certain embodiments, the pharmaceutical compositions are for treating a neoplasia. In certain embodiments, the neoplasia is selected from the group consisting of multiple myeloma, Non-Hodgkin Lymphoma (especially Mantle Cell), Hodgkin Lymphoma, Chronic Lymphocytic Leukemia (CLL), Acute lymphocytic leukemia (ALL), Hairy Cell Leukemia, Burketts Lymphoma, and Waldenstrom's Macroglobulinemia. In certain embodiments, the neoplasia is multiple myeloma.

The presently disclosed subject matter further provides kits for treating a neoplasia, comprising the presently disclosed immunoresponsive cells. In certain embodiments, the kit further include written instructions for using the immunoresponsive cell for treating a neoplasia. In certain embodiments, the neoplasia is selected from the group consisting of multiple myeloma, Non-Hodgkin Lymphoma (especially Mantle Cell), Hodgkin Lymphoma, Chronic Lymphocytic Leukemia (CLL), Acute lymphocytic leukemia (ALL), Hairy Cell Leukemia, Burketts Lymphoma, and Waldenstrom's Macroglobulinemia. In certain embodiments, the neoplasia is multiple myeloma.

BRIEF DESCRIPTION OF THE FIGURES

The following Detailed Description, given by way of example, but not intended to limit the invention to specific embodiments described, may be understood in conjunction with the accompanying drawings.

FIG. 3A-D. (A) A representation of the domains of FcRL5 and the soluble, glycosylphosphatidylinositol (GPI)-anchored and transmembrane forms of FcRL5. (B) A representation of the vector used to express a mutated form of FcRL5 that lacks domain 9 (also referred to herein as FcRL5Δdom9). (C) The nucleotide sequences of full length FcRL5 and the form of FcRL5 that lacks domain 9. (D) A representation of the differences in the nucleotide sequences of full length FcRL5 and the mutated form of FcRL5 in which domain 9 is deleted (referred to herein as "FcRL5Δdom9").

FIGS. 9A-B. Schematics of chimeric antigen receptor targeting FcRL5 in accordance with non-limiting embodiments of the presently disclosed subject matter. (A) Schematic of FcRL5-targeted CAR with CD28 co-stimulatory domain and CD3zeta. (B) Schematic of FcRL5-targeted CAR with 4-1BB co-stimulatory domain and CD3zeta.

DETAILED DESCRIPTION OF THE INVENTION

Figure 1:
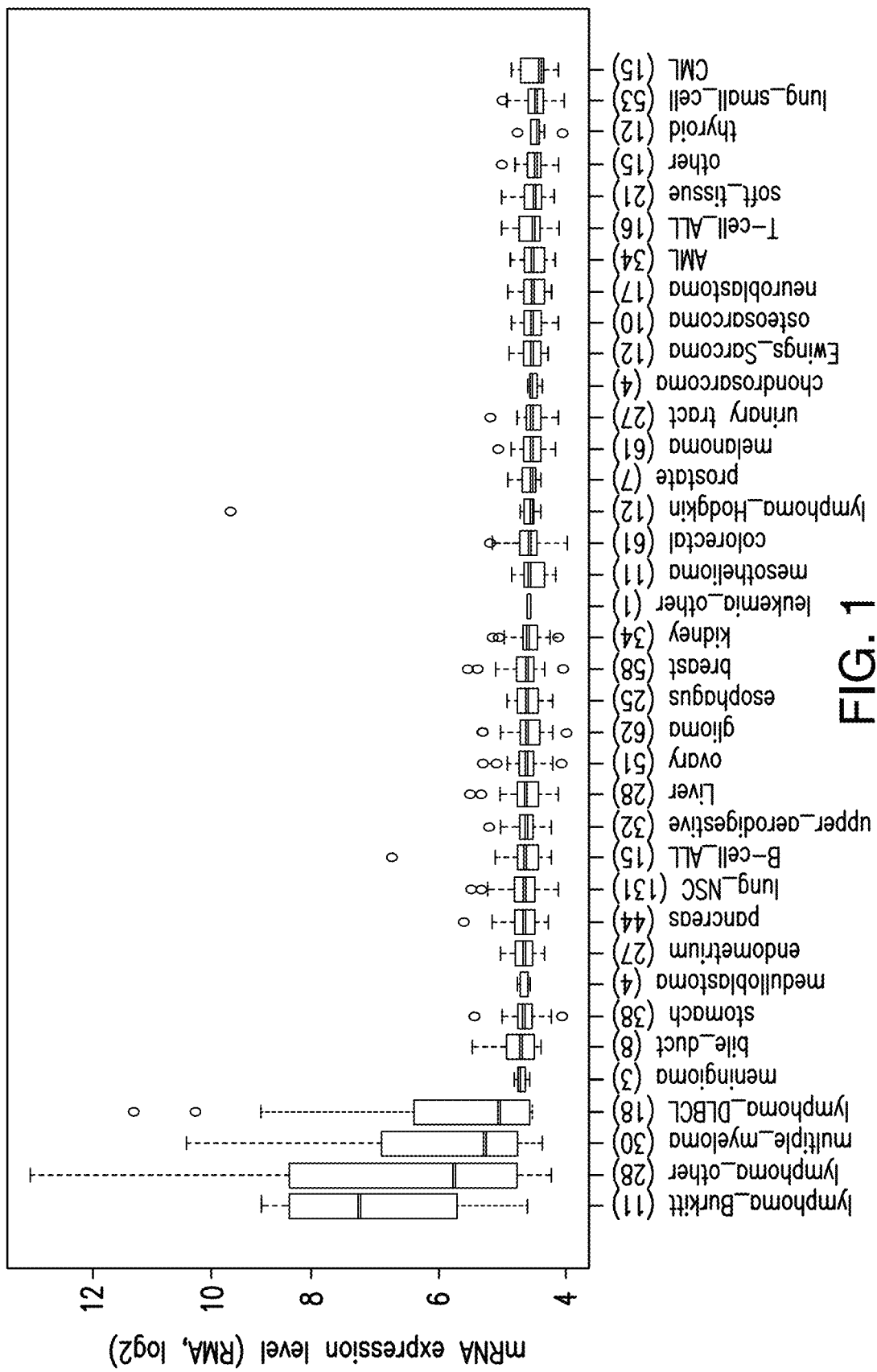
FIG. 1 depicts the FcRL5 expression in various normal tissues and human cancer cell lines.
Figure 1:
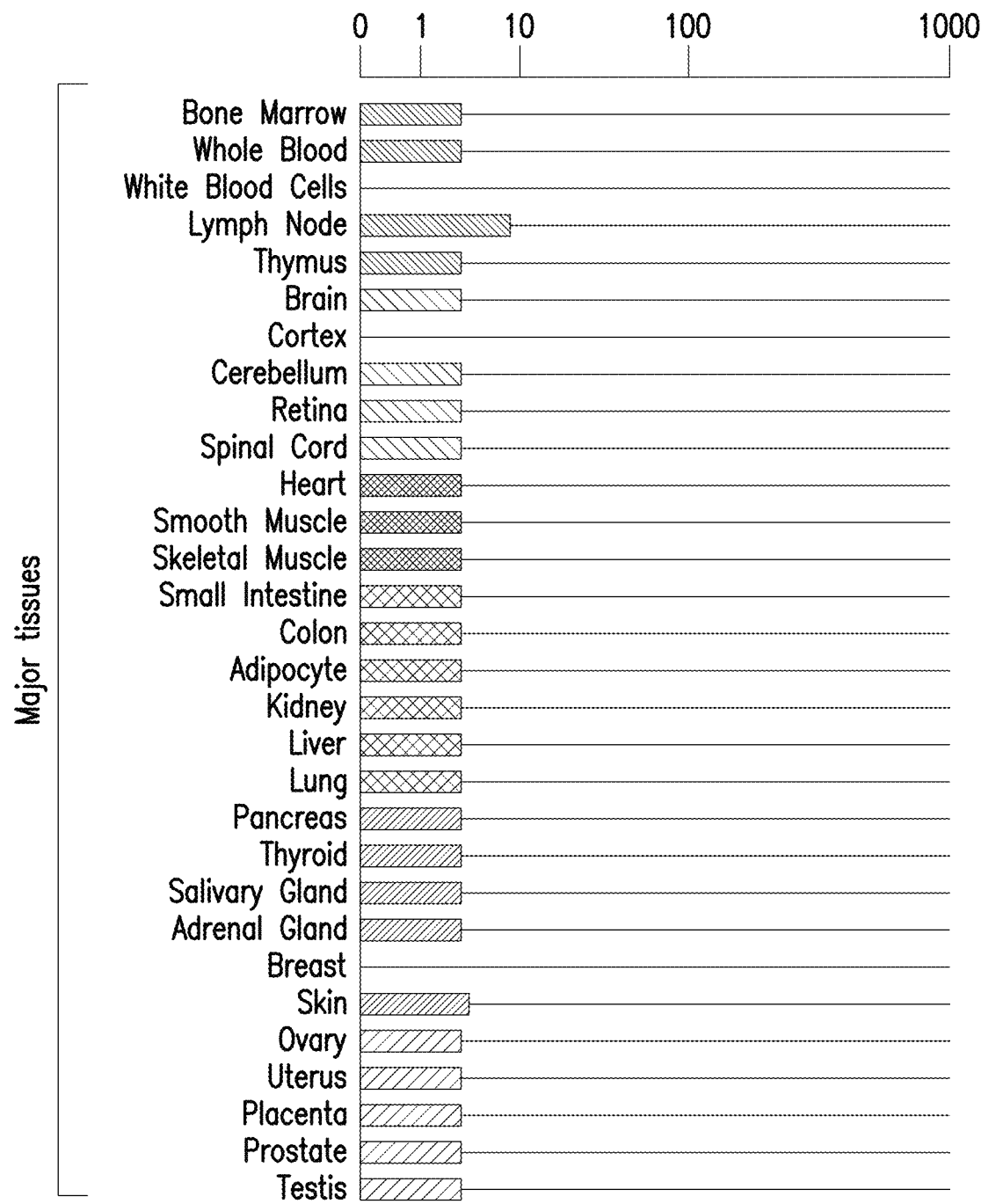
Figure 1:
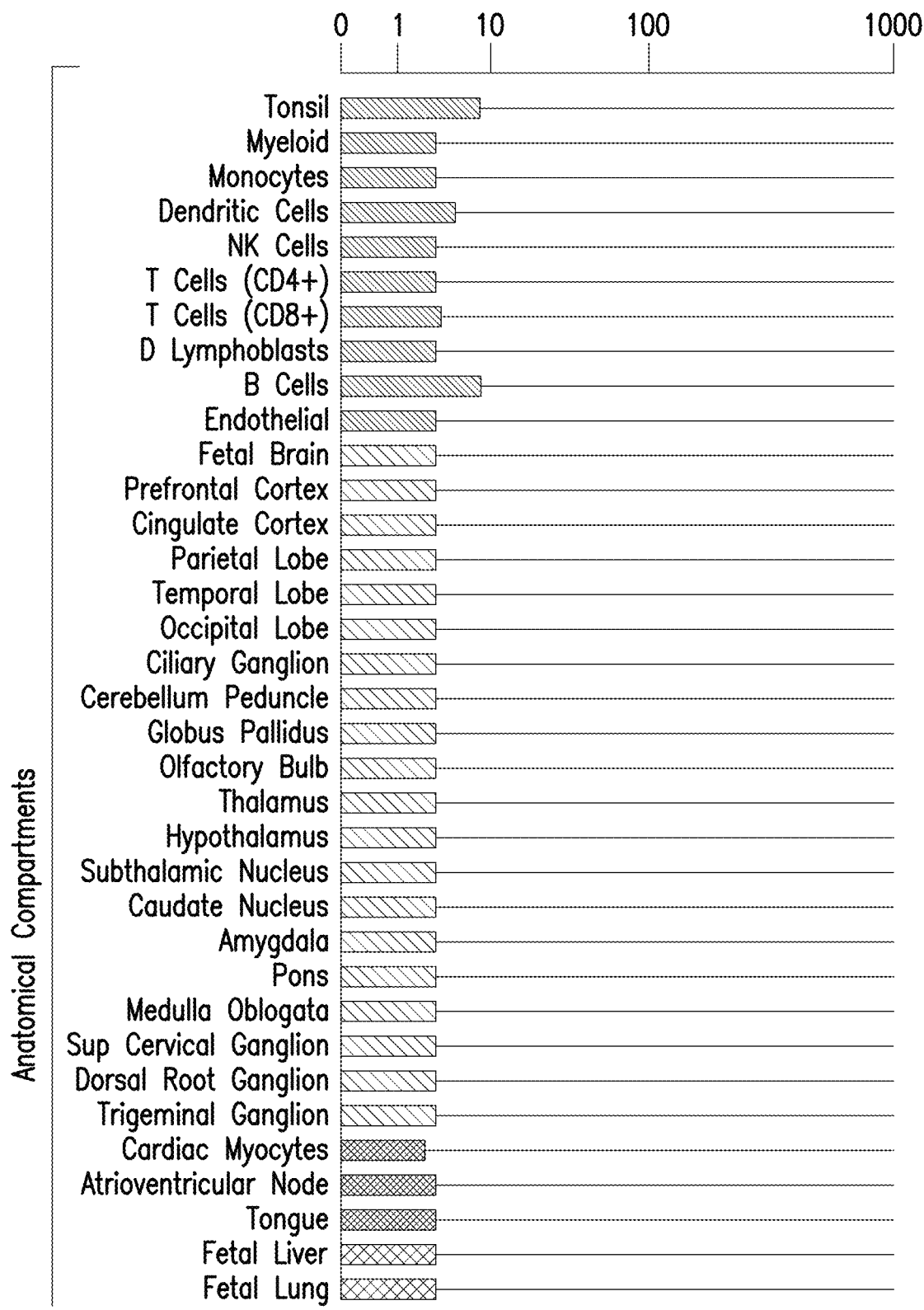
Figure 1:
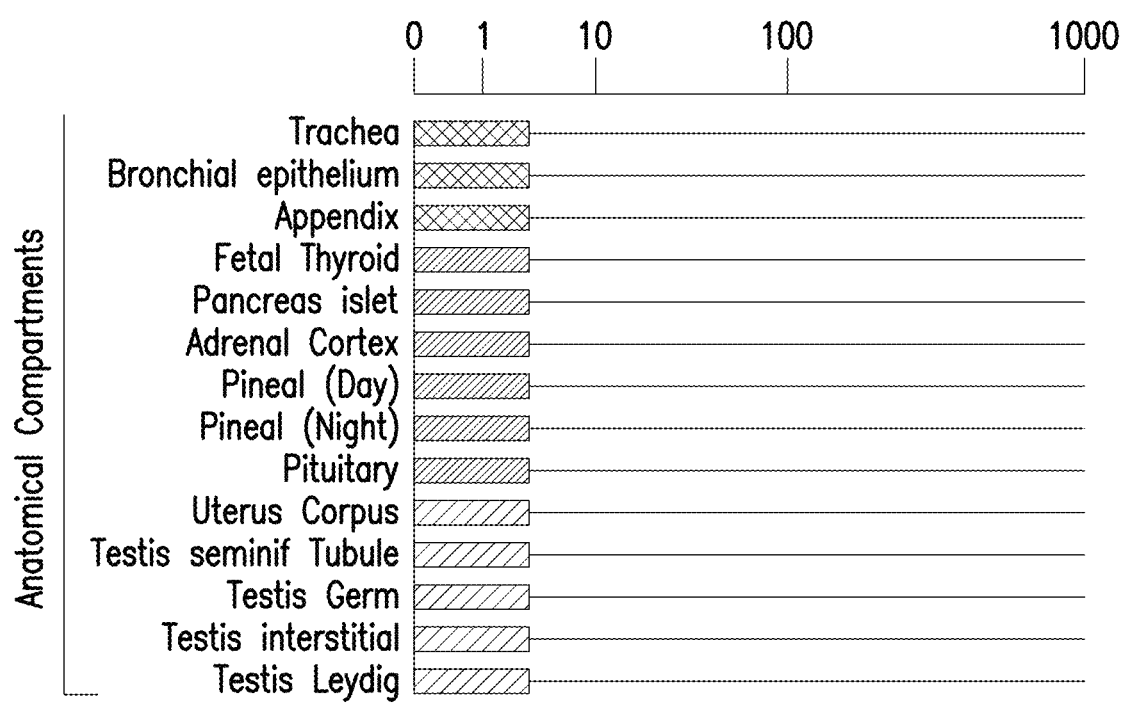

The presently disclosed subject matter generally provides FcRL5-targeted chimeric antigen receptors (CARs). In one non-limiting example, the CAR comprises an extracellular antigen-binding domain, a transmembrane domain and an intracellular domain, where the extracellular antigen-binding domain specifically binds to FcRL5. In certain embodiments, the extracellular antigen-binding domain specifically binds to domain 7, 8 or 9 of FcRL5. The presently disclosed subject matter also provides immunoresponsive cells (e.g., T cell, a Natural Killer (NK) cell, a cytotoxic T lymphocyte (CTL), a regulatory T cell, a human embryonic stem cell, a lymphoid progenitor cell, a T cell-precursor cell, and a pluripotent stem cell from which lymphoid cells may be differentiated) expressing the FcRL5-targeted CARs, and methods of using such immunoresponsive cells for treating a tumor, e.g., multiple myeloma.

I. Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

As used herein, the term "about" or "approximately" means within an acceptable error range for the particular value as determined by one of ordinary skill in the art, which will depend in part on how the value is measured or determined, i.e., the limitations of the measurement system. For example, "about" can mean within 3 or more than 3 standard deviations, per the practice in the art. Alternatively, "about" can mean a range of up to 20%, preferably up to 10%, more preferably up to 5%, and more preferably still up to 1% of a given value. Alternatively, particularly with respect to biological systems or processes, the term can mean within an order of magnitude, preferably within 5-fold, and more preferably within 2-fold, of a value.

As used herein, the term "cell population" refers to a group of at least two cells expressing similar or different phenotypes. In non-limiting examples, a cell population can include at least about 10, at least about 100, at least about 200, at least about 300, at least about 400, at least about 500, at least about 600, at least about 700, at least about 800, at least about 900, at least about 1000 cells expressing similar or different phenotypes.

As used herein, the term "antibody" means not only intact antibody molecules, but also fragments of antibody molecules that retain immunogen-binding ability. Such fragments are also well known in the art and are regularly employed both in vitro and in vivo. Accordingly, as used herein, the term "antibody" means not only intact immunoglobulin molecules but also the well-known active fragments F(ab')$_2$, and Fab. F(ab')$_2$, and Fab fragments that lack the Fc fragment of intact antibody, clear more rapidly from the circulation, and may have less non-specific tissue binding of an intact antibody (Wahl et al., J. Nucl. Med. 24:316-325 (1983). The antibodies of the invention comprise whole native antibodies, bispecific antibodies; chimeric antibodies; Fab, Fab', single chain V region fragments (scFv), fusion polypeptides, and unconventional antibodies.

As used herein, the term "single-chain variable fragment" or "scFv" is a fusion protein of the variable regions of the heavy (V$_H$) and light chains (V$_L$) of an immunoglobulin (e.g., mouse or human) covalently linked to form a V$_H$:VL heterodimer. The heavy (V$_H$) and light chains (V$_L$) are either joined directly or joined by a peptide-encoding linker (e.g., 10, 15, 20, 25 amino acids), which connects the N-terminus of the V$_H$ with the C-terminus of the V$_L$, or the C-terminus of the V$_H$ with the N-terminus of the V$_L$. The linker is usually rich in glycine for flexibility, as well as serine or threonine for solubility. The linker can link the heavy chain variable region and the light chain variable region of the extracellular antigen-binding domain. Non-limiting examples of linkers are disclosed in Shen et al., Anal. Chem. 80(6):1910-1917 (2008) and WO 2014/087010, the contents of which are hereby incorporated by reference in their entireties. In certain embodiments, the linker is a G45 linker.

In a non-limiting example, the linker comprises amino acids having the sequence set forth in SEQ ID NO:897 as provided below. GGGGSGGGGSGGGGS [ SEQ ID NO: 897]. In certain embodiments, the nucleic acid sequence encoding the amino acid sequence of SEQ ID NO:897 is set forth in SEQ ID NO:898, which is provided below: GGTGGAGGTGGATCAGGTGGAGGTGGATCTGGTGGAGGTGGATCT [SEQ ID NO:898].

In another non-limiting example, the linker comprises amino acids having the sequence set forth in SEQ ID NO:307 as provided below: SRGGGGSGGGGSGGGGSLEMA [SEQ ID No: 307]. In certain embodiments, the nucleic acid sequence encoding the amino acid sequence of SEQ ID NO:307 is set forth in SEQ ID NO:305, which is provided below:

[SEQ ID NO: 305]
TCTAGAGGTGGTGGTGGTAGCGGCGGCGGCGGCTCTGGTGGTGGTGGATC

CCTCGAGATGGCC.

Despite removal of the constant regions and the introduction of a linker, scFv proteins retain the specificity of the original immunoglobulin. Single chain Fv polypeptide antibodies can be expressed from a nucleic acid comprising $V_H$- and $V_L$-encoding sequences as described by Huston, et al. (Proc. Nat. Acad. Sci. USA, 85:5879-5883, 1988). See, also, U.S. Pat. Nos. 5,091,513, 5,132,405 and 4,956,778; and U.S. Patent Publication Nos. 20050196754 and 20050196754. Antagonistic scFvs having inhibitory activity have been described (see, e.g., Zhao et al., Hyrbidoma (Larchmt) 2008 27(6):455-51; Peter et al., J Cachexia Sarcopenia Muscle 2012 Aug. 12; Shieh et al., J Imunol 2009 183(4):2277-85; Giomarelli et al., Thromb Haemost 2007 97(6):955-63; Fife eta., J Clin Invst 2006 116(8):2252-61; Brocks et al., Immunotechnology 1997 3(3):173-84; Moosmayer et al., Ther Immunol 1995 2 (10:31-40). Agonistic scFvs having stimulatory activity have been described (see, e.g., Peter et al., J Bioi Chem 2003 25278(38):36740-7; Xie et al., Nat Biotech 1997 15(8):768-71; Ledbetter et al., Crit Rev Immunol 1997 17 (5-6): 427-55; Ho et al., BioChim Biophys Acta 2003 1638(3):257-66).

As used herein, "F(ab)" refers to a fragment of an antibody structure that binds to an antigen but is monovalent and does not have a Fc portion, for example, an antibody digested by the enzyme papain yields two F(ab) fragments and an Fc fragment (e.g., a heavy (H) chain constant region; Fc region that does not bind to an antigen).

As used herein, "F(ab')$_2$" refers to an antibody fragment generated by pepsin digestion of whole IgG antibodies, wherein this fragment has two antigen binding (ab') (bivalent) regions, wherein each (ab') region comprises two separate amino acid chains, a part of a H chain and a light (L) chain linked by an S—S bond for binding an antigen and where the remaining H chain portions are linked together. A "F(ab')$_2$" fragment can be split into two individual Fab' fragments.

As used herein, the term "vector" refers to any genetic element, such as a plasmid, phage, transposon, cosmid, chromosome, virus, virion, etc., which is capable of replication when associated with the proper control elements and which can transfer gene sequences into cells. Thus, the term includes cloning and expression vehicles, as well as viral vectors and plasmid vectors.

As used herein, the term "expression vector" refers to a recombinant nucleic acid sequence, i.e., recombinant DNA molecule, containing a desired coding sequence and appropriate nucleic acid sequences necessary for the expression of the operably linked coding sequence in a particular host organism. Nucleic acid sequences necessary for expression in prokaryotes usually include a promoter, an operator (optional), and a ribosome binding site, often along with other sequences. Eukaryotic cells are known to utilize promoters, enhancers, and termination and polyadenylation signals.

As used herein, "CDRs" are defined as the complementarity determining region amino acid sequences of an antibody which are the hypervariable regions of immunoglobulin heavy and light chains. See, e.g., Kabat et al., Sequences of Proteins of Immunological Interest, 4th U. S. Department of Health and Human Services, National Institutes of Health (1987). Generally, antibodies comprise three heavy chain and three light chain CDRs or CDR regions in the variable region. CDRs provide the majority of contact residues for the binding of the antibody to the antigen or epitope. In certain embodiments, the CDRs regions are delineated using the Kabat system (Kabat, E. A., et al. (1991) Sequences of Proteins of Immunological Interest, Fifth Edition, U.S. Department of Health and Human Services, NIH Publication No. 91-3242).

As used herein, the term "affinity" is meant a measure of binding strength. Without being bound to theory, affinity depends on the closeness of stereochemical fit between antibody combining sites and antigen determinants, on the size of the area of contact between them, and on the distribution of charged and hydrophobic groups. Affinity also includes the term "avidity," which refers to the strength of the antigen-antibody bond after formation of reversible complexes. Methods for calculating the affinity of an antibody for an antigen are known in the art, comprising use of binding experiments to calculate affinity. Antibody activity in functional assays (e.g., flow cytometry assay) is also reflective of antibody affinity. Antibodies and affinities can be phenotypically characterized and compared using functional assays (e.g., flow cytometry assay).

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a preferred: embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide, and 100 µg/ml denatured salmon sperm DNA (ssDNA). In a most preferred embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In a preferred embodiment, wash steps will occur at 25° C. in 30 mM NaCl, 3 mM trisodium citrate, and 0.1% SDS. In a more preferred embodiment, wash steps will occur at 42° C. in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196:180, 1977); Grunstein and Rogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). Preferably, such a sequence is at least 60%, more preferably 80% or 85%, and more preferably 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications.

In an exemplary approach to determining the degree of identity, a BLAST program may be used, with a probability score between e-3 and e-100 indicating a closely related sequence.

As used herein, the term "analog" refers to a structurally related polypeptide or nucleic acid molecule having the function of a reference polypeptide or nucleic acid molecule.

As used herein, the term "ligand" refers to a molecule that binds to a receptor. In particular, the ligand binds a receptor on another cell, allowing for cell-to-cell recognition and/or interaction.

As used herein, the term "disease" refers to any condition or disorder that damages or interferes with the normal function of a cell, tissue, or organ. Examples of diseases include neoplasia or pathogen infection of cell.

As used herein, the term "effective amount" refers to an amount sufficient to have a therapeutic effect. In certain embodiments, an "effective amount" is an amount sufficient to arrest, ameliorate, or inhibit the continued proliferation, growth, or metastasis (e.g., invasion, or migration) of a neoplasia.

As used herein, the term "heterologous nucleic acid molecule or polypeptide" refers to a nucleic acid molecule (e.g., a cDNA, DNA or RNA molecule) or polypeptide that is not normally present in a cell or sample obtained from a cell. This nucleic acid may be from another organism, or it may be, for example, an mRNA molecule that is not normally expressed in a cell or sample.

As used herein, the term "immunoresponsive cell" refers to a cell that functions in an immune response or a progenitor, or progeny thereof.

As used herein, the term "modulate" refers positively or negatively alter. Exemplary modulations include an about 1%, about 2%, about 5%, about 10%, about 25%, about 50%, about 75%, or about 100% change.

As used herein, the term "increase" refers to alter positively by at least about 5%, including, but not limited to, alter positively by about 5%, by about 10%, by about 25%, by about 30%, by about 50%, by about 75%, or by about 100%.

As used herein, the term "reduce" refers to alter negatively by at least about 5% including, but not limited to, alter negatively by about 5%, by about 10%, by about 25%, by about 30%, by about 50%, by about 75%, or by about 100%.

As used herein, the term "isolated cell" refers to a cell that is separated from the molecular and/or cellular components that naturally accompany the cell.

As used herein, the term "isolated," "purified," or "biologically pure" refers to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

As used herein, the term "secreted" is meant a polypeptide that is released from a cell via the secretory pathway through the endoplasmic reticulum, Golgi apparatus, and as a vesicle that transiently fuses at the cell plasma membrane, releasing the proteins outside of the cell.

As used herein, the term "specifically binds" or "specifically binds to" or "specifically target" is meant a polypeptide or fragment thereof that recognizes and binds a biological molecule of interest (e.g., a polypeptide), but which does not substantially recognize and bind other molecules in a sample, for example, a biological sample, which naturally includes a polypeptide of the invention.

As used herein, the term "treating" or "treatment" refers to clinical intervention in an attempt to alter the disease course of the individual or cell being treated, and can be performed either for prophylaxis or during the course of clinical pathology. Therapeutic effects of treatment include, without limitation, preventing occurrence or recurrence of disease, alleviation of symptoms, diminishment of any direct or indirect pathological consequences of the disease, preventing metastases, decreasing the rate of disease progression, amelioration or palliation of the disease state, and remission or improved prognosis. By preventing progression of a disease or disorder, a treatment can prevent deterioration due to a disorder in an affected or diagnosed subject or a subject suspected of having the disorder, but also a treatment may prevent the onset of the disorder or a symptom of the disorder in a subject at risk for the disorder or suspected of having the disorder.

As used herein, the term "subject" refers to any animal (e.g., a mammal), including, but not limited to, humans, non-human primates, rodents, and the like (e.g., which is to be the recipient of a particular treatment, or from whom cells are harvested).

II. Fc Receptor-Like 5 (FcRL5)

Fc Receptor-Like 5 (FcRL5) (also known as "CD307e" or "IRTA2") is a rational target for treating multiple myeloma as it is expressed on B cells and plasma cells. FcRL5 binds to the Fc portion of IgG and contributes to B cell receptor signaling and B cell proliferation (Franco et al., *Journal of immunology* 190, 5739-5746 (2013); Dement-Brown et al., *Journal of leukocyte biology* 91, 59-67 (2012). FcRL5 was found to be an alternative to CD138 as a FACS marker for malignant plasma cells from fresh or frozen patient samples with a mean relative MFI between 10-55 (n=23) (Ise et al., *Leukemia* 21, 169-174 (2007)). Another study confirmed cell surface expression of FcRL5 by FACS on primary patient samples from most chronic lymphocytic leukemia (CLL), and mantle cell lymphoma cases, and all multiple myeloma (MM) (n=8) cases tested (Ise et al. (2007)). A third group found high surface staining on plasma cells from normal bone marrows (n=7), in MGUS (n=16), and in MM (n=16), (MFI similar in all three groups, ~1000 fold increase compared to isotype control) (Elkins et al., *Molecular cancer therapeutics* 11, 2222-2232 (2012)). FcRL5 is on 1q21 and has been found to be involved in 1q21 abnormalities in B cell malignancies (Hatzivassiliou et al., *Immunity* 14, 277-289 (2001)). Amplification of 1q21 is found in 48% of MM patients at diagnosis and 67% of patients at relapse, and correlates with a worse prognosis (An et al., *Haematologica* 99, 353-359 (2014)). An antibody-drug conjugate targeting FcRL5 was effective in treating an in vivo murine model of MM (Elkins et al. (2012)).

Non-limiting examples of human FcRL5 amino acid sequences can be found under GenBank Protein Accession Nos: AAI01070.1; XP_011508332.1; XP_011508334.1; XP_011508333.1; XP_011508332.1; and NP_001182317.1.

In certain non-limiting embodiments, FcRL5 is human FcRL5 having the amino acid sequence set forth in SEQ ID NO:899, or fragments thereof. SEQ ID NO:899 is provided below:

[SEQ ID NO: 899]
MLLWVILLVLAPVSGQFARTPRPIIFLQPPWTTVFQGERVTLTCKGFRFY

SPQKTKWYHRYLGKEILRETPDNILEVQESGEYRCQAQGSPLSSPVHLDF

SSASLILQAPLSVFEGDSVVLRCRAKAEVTLNNTIYKNDNVLAFLNKRTD

FHIPHACLKDNGAYRCTGYKESCCPVSSNTVKIQVQEPFTRPVLRASSFQ

PISGNPVTLTCETQLSLERSDVPLRFRFFRDDQTLGLGWSLSPNFQITAM

WSKDSGFYWCKAATMPHSIISDSPRSWIQVQIPASHPVLTLSPEKALNFE

GTKVTLHCETQEDSLRTLYRFYHEGVPLRHKSVRCERGASISFSLTTENS

GNYYCTADNGLGAKPSKAVSLSVTVPVSHPVLNLSSPEDLIFEGAKVTLH

CEAQRGSLPILYQFHHEDAALERRSANSAGGVAISFSLTAEHSGNYYCTA

DNGFGPQRSKAVSLSITVPVSHPVLTLSSAEALTFEGATVTLHCEVQRGS

PQILYQFYHEDMPLWSSSTPSVGRVSFSFSLTEGHSGNYYCTADNGFGPQ

RSEVVSLFVTVPVSRPILTLRVPRAQAVVGDLLELHCEAPRGSPPILYWF

YHEDVTLGSSSAPSGGEASFNLSLTAEHSGNYSCEANNGLVAQHSDTISL

SVIVPVSRPILTFRAPRAQAVVGDLLELHCEALRGSSPILYWFYHEDVTL

GKISAPSGGGASFNLSLTTEHSGIYSCEADNGLEAQRSEMVTLKVAVPVS

RPVLTLRAPGTHAAVGDLLELHCEALRGSPLILYRFFHEDVTLGNRSSPS

GGASLNLSLTAEHSGNYSCEADNGLGAQRSETVTLYITGLTANRSGPFAT

GVAGGLLSIAGLAAGALLLYCWLSRKAGRKPASDPARSPSDSDSQEPTYH

NVPAWEELQPVYTNANPRGENVVYSEVRIIQEKKKHAVASDPRHLRNKGS

PIIYSEVKVASTPVSGSLFLASSAPHR.

Figure 3A:
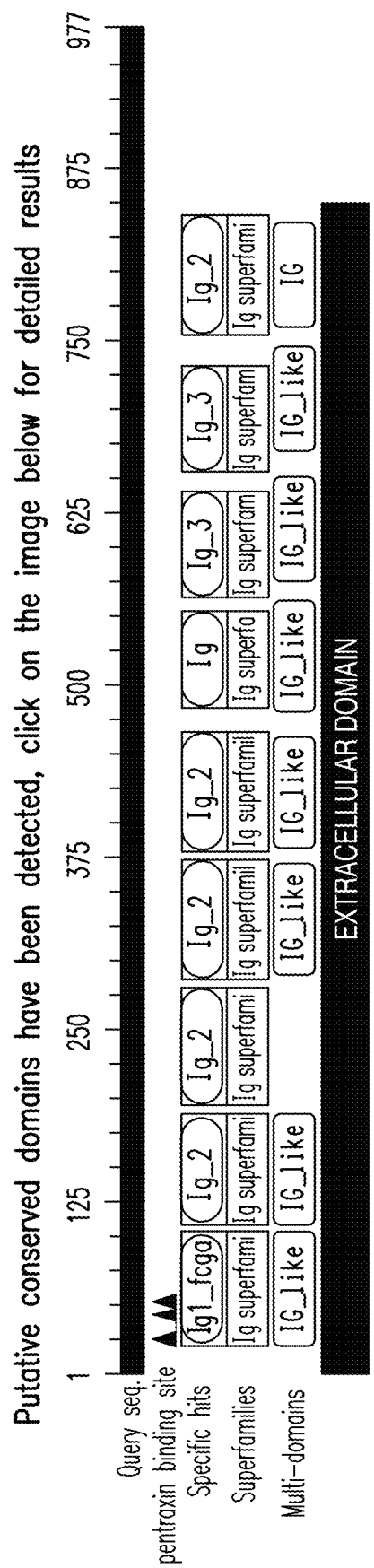
Figure 3A:
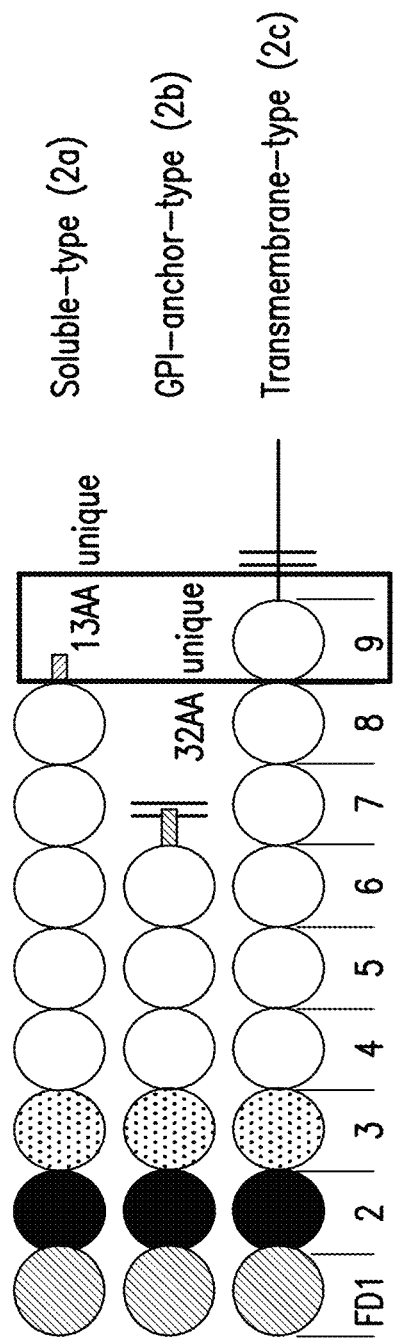
Figure 3B:
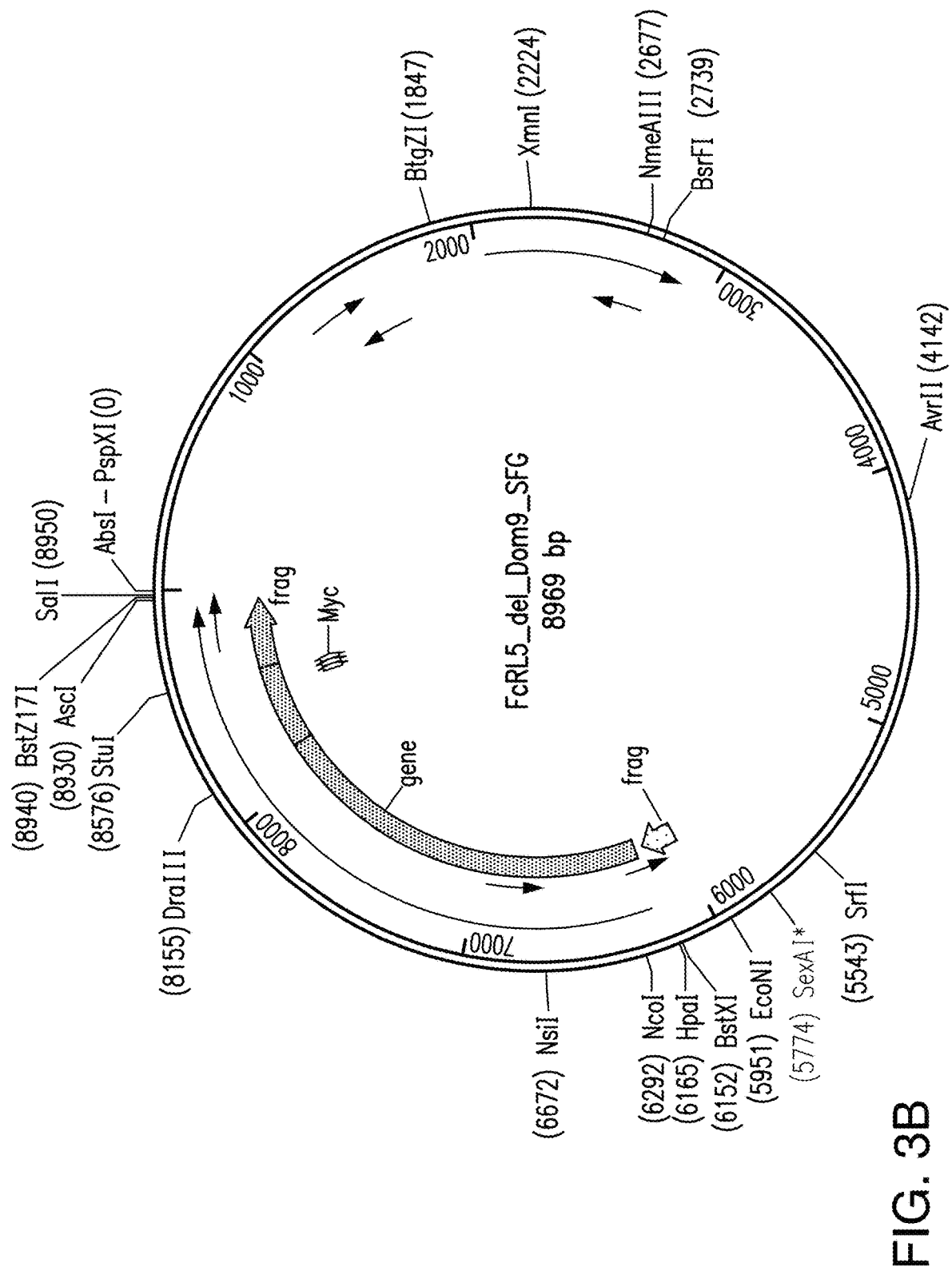

In certain embodiments, FcRL5 comprises 9 immunoglobulin (Ig)-like domains, e.g., domain 1, domain 2, domain 3, domain 4, domain 5, domain 6, domain 7, domain 8 and domain 9 (see FIGS. 3A and 3C). In certain embodiments, domain 9 of FcRL5 comprises the amino acid sequence set forth in SEQ ID NO:900. SEQ ID NO:900 is provided below.

[SEQ ID NO: 900]
RPVLTLRAPGTHAAVGDLLELHCEALRGSPLILYRFFHEDVTLGNRSSPS

GGASLNLSLTAEHSGNYSCEADNGLGAQRSETVTLYI.

In certain embodiments, domain 9 of FcRL5 can have the amino acid sequence set forth in SEQ ID NO:963, or fragments thereof. SEQ ID NO:963 is provided below:

[SEQ ID NO: 963]
GTHAAVGDLLELHCEALRGSPLILYRFFHEDVTLGNRSSPSGGASLNLSL

TAEHSGNYSCEADNGLGAQRSETVTLYI.

In certain embodiments, domain 1 can comprise amino acids 23-100 of SEQ ID NO:899; domain 2 can comprise amino acids 105-185 of SEQ ID NO:899; domain 3 can comprise amino acids 191-273 of SEQ ID NO:899; domain 4 can comprise amino acids 287-373 of SEQ ID NO:899; domain 5 can comprise amino acids 380-466 of SEQ ID NO:899; domain 6 can comprise amino acids 490-555 of SEQ ID NO:899; domain 7 can comprise amino acids 565-638 of SEQ ID NO:899; domain 8 can comprise amino acids 658-731 of SEQ ID NO:899; and domain 9 can comprise amino acids 754-835 of SEQ ID NO:899.

In certain embodiments, domain 9 of FcRL5 comprises an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence of SEQ ID NO:900 or 963.

III. Chimeric Antigen Receptor (CAR)

Chimeric antigen receptors (CARs) are engineered receptors, which graft or confer a specificity of interest onto an immune effector cell. CARs can be used to graft the specificity of a monoclonal antibody onto a T cell; with transfer of their coding sequence facilitated by retroviral vectors.

There are three generations of CARs. "First generation" CARs are typically composed of an extracellular antigen binding domain (e.g., a single-chain variable fragments (scFv)) fused to a transmembrane domain, fused to cytoplasmic/intracellular domain of the T cell receptor chain. "First generation" CARs typically have the intracellular domain from the CD3ζ-chain, which is the primary transmitter of signals from endogenous TCRs. "First generation" CARs can provide de novo antigen recognition and cause activation of both CD4$^+$ and CD8$^+$ T cells through their CD3ζ chain signaling domain in a single fusion molecule, independent of HLA-mediated antigen presentation. "Second generation" CARs add intracellular domains from various co-stimulatory molecules (e.g., CD28, 4-1BB, ICOS, OX40) to the cytoplasmic tail of the CAR to provide additional signals to the T cell. "Second generation" CARs comprise those that provide both co-stimulation (e.g., CD28 or 4-1BB) and activation (CD3ζ). Preclinical studies have indicated that "Second Generation" CARs can improve the anti-tumor activity of T cells. For example, robust efficacy of "Second Generation" CAR modified T cells was demonstrated in clinical trials targeting the CD19 molecule in patients with chronic lymphoblastic leukemia (CLL) and acute lymphoblastic leukemia (ALL). "Third generation" CARs comprise those that provide multiple co-stimulation (e.g., CD28 and 4-1BB) and activation (CD3ζ).

In accordance with the presently disclosed subject matter, the CARs comprise an extracellular antigen-binding domain, a transmembrane domain and an intracellular domain, where the extracellular antigen-binding domain binds to FcRL5. In a specific non-limiting embodiment, the extracellular antigen-binding domain is a scFv. In a specific non-limiting embodiment, the extracellular antigen-binding domain is a Fab, which is optionally crosslinked. In a specific non-limiting embodiment, the extracellular binding domain is a F(ab)$_2$. In a specific non-limiting embodiment, any of the foregoing molecules may be comprised in a fusion protein with a heterologous sequence to form the extracellular antigen-binding domain.

In certain non-limiting embodiments, the extracellular antigen-binding domain of a CAR of the present disclosure has a high binding specificity as well as high binding affinity to FcRL5 or domain 9 of FcRL5. In certain non-limiting embodiments, the extracellular antigen-binding domain of a CAR of the present disclosure has a high binding specificity as well as high binding affinity to domain 8 of FcRL5. In certain non-limiting embodiments, the extracellular antigen-binding domain of a CAR of the present disclosure has a high binding specificity as well as high binding affinity to domain 7 of FcRL5. For example, in such embodiments, the extracellular antigen-binding domain of the CAR (embodied, for example, in an scFv or an analog thereof) binds to FcRL5 (or domain 8 or domain 9 of FcRL5) with a dissociation constant ($K_d$) of about $3\times10^{-6}$ M or less. In certain embodiments, the $K_d$ is about $1\times10^{-6}$ M or less, about $1\times10^{-7}$ M or less, about $1\times10^{-8}$ M or less, about $1\times10^{-9}$ M or less, about $1\times10^{-10}$ M or less or about $1\times10^{-11}$ M or less. In certain embodiments, the $K_d$ is from about $1\times10^{-11}$ M to about $3\times10^{-6}$ M, $1\times10^{-10}$ M to about $3\times10^{-6}$ M or from about $1\times10^{-9}$M to about $3\times10^{-6}$ M, such as from about $1\times10^{-9}$M to about $1\times10^{-8}$ M, from about $1\times10^{-8}$M to about $1\times10^{-7}$ M, or from about $1\times10^{-7}$M to about $1\times10^{-6}$ M, or from about $1\times10^{-6}$ M to about $3\times10^{-6}$ M.

Binding of the extracellular antigen-binding domain (embodiment, for example, in an scFv or an analog thereof) of a presently disclosed CAR to FcRL5 (or domain 8 or domain 9 of FcRL5) can be confirmed by, for example, enzyme-linked immunosorbent assay (ELISA), radioimmunoassay (RIA), FACS analysis, bioassay (e.g., growth inhibition), or Western Blot assay. Each of these assays generally detect the presence of protein-antibody complexes of particular interest by employing a labeled reagent (e.g., an antibody, or an scFv) specific for the complex of interest. For example, the scFv can be radioactively labeled and used in a radioimmunoassay (RIA) (see, for example, Weintraub, B., Principles of Radioimmunoassays, Seventh Training Course on Radioligand Assay Techniques, The Endocrine Society, March, 1986, which is incorporated by reference herein). The radioactive isotope can be detected by such means as the use of a γ counter or a scintillation counter or by autoradiography. In certain embodiments, the FcRL5-targeted extracellular antigen-binding domain is labeled with a fluorescent marker. Non-limiting examples of fluorescent markers include green fluorescent protein (GFP), blue fluorescent protein (e.g., EBFP, EBFP2, Azurite, and mKalamal), cyan fluorescent protein (e.g., ECFP, Cerulean, and CyPet), and yellow fluorescent protein (e.g., YFP, Citrine, Venus, and YPet). In certain embodiments, the FcRL5-targeted human scFv is labeled with GFP.

In certain embodiments, the extracellular antigen-binding domain of a presently disclosed CAR comprises a single-chain variable fragment (scFv). In one specific embodiment, the extracellular antigen-binding domain of a presently disclosed CAR comprises a human scFv that specifically binds to human FcRL5. In another specific embodiment, the extracellular antigen-binding domain of a presently disclosed CAR comprises a murine scFv that specifically binds to human FcRL5. In certain embodiments, the extracellular antigen-binding domain of a presently disclosed CAR comprises a scFv that specifically binds to at least a portion of domain 7 of FcRL5. In certain embodiments, the extracellular antigen-binding domain of a presently disclosed CAR comprises a scFv that specifically binds to at least a portion of domain 8 of FcRL5. In certain embodiments, the extracellular antigen-binding domain of a presently disclosed CAR comprises a scFv that specifically binds to at least a portion of domain 9 of FcRL5. For example, and not by way of limitation, domain 9 of FcRL5 comprises the amino acid sequence set forth in SEQ ID NO:900 or 963, or fragments thereof.

In certain embodiments, the extracellular antigen-binding domain is a murine scFv obtained from two commercially available mouse hybridomas binding different extracellular epitopes on human FcRL5, which have been characterized in the Franco et al., *Journal of Immunology* (2013); 190: 5739-5746; Ise et al., *Clinical cancer research: an official journal of the American Association for Cancer Research* (2005); 11:87-96; and Ise et al., *Clinical chemistry and laboratory medicine: CCLM/FESCC* (2006); 44:594-602, each of which are herein incorporated by reference in their entireties. In certain embodiments, the extracellular antigen-binding domain is a murine scFv that is derived from a heavy chain variable region and a light chain variable region of an antibody that binds to human FcRL5, e.g., antibodies F56 and F119 as disclosed in Ise et al. (2005), which is herein incorporated by reference in its entirety.

Extracellular Antigen-Binding Domain of A CAR

In certain embodiments, the extracellular antigen-binding domain (e.g., scFv) comprises a light chain variable region comprising an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299, SEQ ID NO:303, SEQ ID NO:917 and SEQ ID NO:921, wherein the scFv antibody binds to an FcRL5 polypeptide.

In certain embodiments, the extracellular antigen-binding domain (e.g., scFv) comprises a heavy chain variable region comprising an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300, SEQ ID NO:304, SEQ ID NO:915 and SEQ ID NO:919.

In certain embodiments, the extracellular antigen-binding domain (e.g., scFv) comprises a heavy chain variable region comprising amino acids having the sequence set forth in SEQ ID NO:915 as provided below.

[SEQ ID NO: 915]
VKLQESGGGLVQPGGSRKLSCAASGFTFSIFGLHWVRQAPEKGLEWVAYI

SGDSNTIYYADTVKGRFTISRDNPKNTLFLQMTSLRSEDTAMYYCARNSY

YALDYWGQGTTVTVSS

The nucleic acid sequence encoding the amino acid sequence of SEQ ID NO:915 is set forth in SEQ ID NO:916 as provided below.

[SEQ ID NO: 916]
GTGAAGCTGCAGGAGTCTGGGGGAGGCTTAGTGCAGCCTGGAGGGTCCCG

GAAACTCTCCTGTGCAGCCTCTGGATTCACTTTCAGTATCTTTGGATTGC

ACTGGGTTCGTCAGGCTCCAGAGAAGGGGCTGGAGTGGGTCGCATACATT

AGTGGTGACAGTAATACCATCTACTATGCAGACACAGTGAAGGGCCGATT

CACCATCTCCAGAGACAATCCCAAGAACACCCTGTTCCTGCAAATGACCA

GTCTAAGGTCTGAGGACACGGCCATGTATTACTGTGCAAGAAATAGCTAC

TATGCTCTGGACTACTGGGGCCAAGGGACCACGGTCACCGTCTCCTCA

In certain embodiments, the extracellular antigen-binding domain (e.g., scFv) comprises a light chain variable region comprising amino acids having the sequence set forth in SEQ ID NO:917 as provided below.

[SEQ ID NO: 917]
DIELTQSPAIMSVSPGEKVTMTCRASSSVSSSYLHWYQQRSGASPKIWIY

STSNLASGVPARFSGSGTGTSYSLTISSVEAEDAATYYCQQYSGYPWTFG

GGTKLEI

The nucleic acid sequence encoding the amino acid sequence of SEQ ID NO:917 is set forth in SEQ ID NO:918 as provided below.

[SEQ ID NO: 918]
GACATTGAGCTCACCCAGTCTCCAGCAATCATGTCTGTATCTCCAGGTGA

AAAGGTCACCATGACCTGCAGGGCCAGCTCAAGTGTCAGTTCCAGTTACT

TGCACTGGTACCAGCAGAGGTCAGGTGCCTCCCCCAAAATCTGGATTTAT

AGCACATCCAACTTGGCTTCTGGAGTCCCTGCTCGCTTCAGTGGCAGTGG

GACTGGGACCTCTTACTCTCTCACAATCAGCAGTGTGGAGGCTGAAGATG

CTGCCACTTATTACTGCCAGCAGTACAGTGGTTACCCGTGGACGTTCGGT

GGAGGGACCAAGCTGGAGATC

In certain embodiments, the extracellular antigen-binding domain (e.g., scFv) comprises a heavy chain variable region comprising amino acids having the sequence set forth in SEQ ID NO:919 as provided below.

[SEQ ID NO: 919]
VQLQESGGGLVQPGGSRKLSCTASGFTFSSFGMHWVRQAPEKGLEWVAYI

SSGSNNIYFADTVKGRFTISRDNPKNTLFLQMTSLRSEDTAMYYCARSEY

YGSSHMDYWGQGTTVTVSS

The nucleic acid sequence encoding the amino acid sequence of SEQ ID NO:3 is set forth in SEQ ID NO:920 as provided below.

[SEQ ID NO: 920]
GTCCAACTGCAGGAGTCAGGGGGAGGCTTAGTGCAGCCTGGAGGGTCCCG

GAAACTCTCCTGTACAGCCTCTGGATTCACTTTCAGTAGCTTTGGAATGC

ACTGGGTTCGTCAGGCTCCAGAGAAGGGGCTGGAGTGGGTCGCATACATT

AGTAGTGGCAGTAATAACATCTACTTTGCGGACACAGTGAAGGGCCGATT

CACCATCTCCAGAGACAATCCCAAGAACACCCTGTTCCTGCAAATGACCA

GTCTAAGGTCTGAGGACACGGCCATGTATTACTGTGCAAGATCGGAATAC

TACGGTAGTAGCCATATGGACTACTGGGGCCAAGGGACCACGGTCACCGT

CTCCTCA

In certain embodiments, the extracellular antigen-binding domain (e.g., scFv) comprises a light chain variable region comprising amino acids having the sequence set forth in SEQ ID NO:921 as provided below.

[SEQ ID NO: 921]
DIELTQSPKFMSTSVGDRVSVTCKASQNVGTNVAWYQQKPGQSPKPLIYS

ATYRNSGVPDRFTGSGSGTDFTLTITNVQSKDLADYFCQQYNRYPYTSGG

GTKLEI

The nucleic acid sequence encoding the amino acid sequence of SEQ ID NO:921 is set forth in SEQ ID NO:922 as provided below.

[SEQ ID NO: 922]
GACATTGAGCTCACCCAGTCTCCAAAATTCATGTCCACATCAGTAGGAGA

CAGGGTCAGCGTCACCTGCAAGGCCAGTCAGAATGTGGGTACTAATGTAG

CCTGGTATCAACAGAAACCAGGACAATCTCCTAAACCACTGATTTACTCG

GCAACCTACCGGAACAGTGGAGTCCCTGATCGCTTCACAGGCAGTGGATC

TGGGACAGATTTCACTCTCACCATCACTAACGTGCAGTCTAAAGACTTGG

CAGACTATTTCTGTCAACAATATAACAGGTATCCGTACACGTCCGGAGGG

GGGACCAAGCTGGAGATC

In certain embodiments, the extracellular antigen-binding domain (e.g., scFv) comprises a heavy chain variable region comprising amino acids having the sequence set forth in SEQ ID NO:144. The nucleic acid sequence encoding the amino acid sequence of SEQ ID NO:144 is set forth in SEQ ID NO:142.

In certain embodiments, the extracellular antigen-binding domain (e.g., scFv) comprises a light chain variable region comprising amino acids having the sequence set forth in SEQ ID NO:143. The nucleic acid sequence encoding the amino acid sequence of SEQ ID NO:143 is set forth in SEQ ID NO:141.

In certain embodiments, the extracellular antigen-binding domain (e.g., scFv) comprises a heavy chain variable region comprising amino acids having the sequence set forth in SEQ ID NO:216. The nucleic acid sequence encoding the amino acid sequence of SEQ ID NO:216 is set forth in SEQ ID NO:214.

In certain embodiments, the extracellular antigen-binding domain (e.g., scFv) comprises a light chain variable region comprising amino acids having the sequence set forth in SEQ ID NO:215. The nucleic acid sequence encoding the amino acid sequence of SEQ ID NO:215 is set forth in SEQ ID NO:213.

In certain embodiments, the extracellular antigen-binding domain (e.g., scFv) comprises a heavy chain variable region comprising amino acids having the sequence set forth in SEQ ID NO:220. The nucleic acid sequence encoding the amino acid sequence of SEQ ID NO:220 is set forth in SEQ ID NO:218.

In certain embodiments, the extracellular antigen-binding domain (e.g., scFv) comprises a light chain variable region comprising amino acids having the sequence set forth in SEQ ID NO:219. The nucleic acid sequence encoding the amino acid sequence of SEQ ID NO:219 is set forth in SEQ ID NO:217.

In certain embodiments, the extracellular antigen-binding domain (e.g., scFv) comprises a heavy chain variable region comprising amino acids having the sequence set forth in SEQ ID NO:236. The nucleic acid sequence encoding the amino acid sequence of SEQ ID NO:236 is set forth in SEQ ID NO:234.

In certain embodiments, the extracellular antigen-binding domain (e.g., scFv) comprises a light chain variable region comprising amino acids having the sequence set forth in SEQ ID NO:235. The nucleic acid sequence encoding the amino acid sequence of SEQ ID NO:235 is set forth in SEQ ID NO:232.

In certain embodiments, the extracellular antigen-binding domain (e.g., scFv) comprises a heavy chain variable region comprising amino acids having the sequence set forth in SEQ ID NO:268. The nucleic acid sequence encoding the amino acid sequence of SEQ ID NO:268 is set forth in SEQ ID NO:266.

In certain embodiments, the extracellular antigen-binding domain (e.g., scFv) comprises a light chain variable region comprising amino acids having the sequence set forth in SEQ ID NO:267. The nucleic acid sequence encoding the amino acid sequence of SEQ ID NO:267 is set forth in SEQ ID NO:265.

In certain embodiments, the extracellular antigen-binding domain (e.g., scFv) comprises a heavy chain variable region comprising amino acids having the sequence set forth in SEQ ID NO:172. The nucleic acid sequence encoding the amino acid sequence of SEQ ID NO:172 is set forth in SEQ ID NO:170.

In certain embodiments, the extracellular antigen-binding domain (e.g., scFv) comprises a light chain variable region comprising amino acids having the sequence set forth in SEQ ID NO:171. The nucleic acid sequence encoding the amino acid sequence of SEQ ID NO:171 is set forth in SEQ ID NO:169.

In certain embodiments, the extracellular antigen-binding domain (e.g., scFv) comprises a heavy chain variable region comprising amino acids having the sequence set forth in SEQ ID NO:116. The nucleic acid sequence encoding the amino acid sequence of SEQ ID NO:116 is set forth in SEQ ID NO:114.

In certain embodiments, the extracellular antigen-binding domain (e.g., scFv) comprises a light chain variable region comprising amino acids having the sequence set forth in SEQ ID NO:115. The nucleic acid sequence encoding the amino acid sequence of SEQ ID NO:115 is set forth in SEQ ID NO:113.

In certain embodiments, the extracellular antigen-binding domain (e.g., scFv) comprises (a) a light chain variable region comprising an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299, SEQ ID NO:303, SEQ ID NO:917, SEQ ID NO:921 and (b) a heavy chain variable region comprising an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300, SEQ ID NO:304, SEQ ID NO:917 and SEQ ID NO:921, wherein the extracellular binding domain binds to an FcRL5 polypeptide.

In certain embodiments, the extracellular antigen-binding domain (e.g., scFv) comprises (a) a light chain variable region comprising amino acids having a sequence set forth in SEQ ID NO:3, and (b) a heavy chain variable region comprising amino acids having a sequence set forth in SEQ ID NO:4.

In certain embodiments, the extracellular antigen-binding domain (e.g., scFv) comprises (a) a light chain variable region comprising amino acids having a sequence set forth in SEQ ID NO:7, and (b) a heavy chain variable region comprising amino acids having a sequence set forth in SEQ ID NO:8.

In certain embodiments, the extracellular antigen-binding domain (e.g., scFv) comprises (a) a light chain variable region comprising amino acids having a sequence set forth in SEQ ID NO:11, and (b) a heavy chain variable region comprising amino acids having a sequence set forth in SEQ ID NO:12.

In certain embodiments, the extracellular antigen-binding domain (e.g., scFv) comprises (a) a light chain variable region comprising amino acids having a sequence set forth in SEQ ID NO:15, and (b) a heavy chain variable region comprising amino acids having a sequence set forth in SEQ ID NO:16.

In certain embodiments, the extracellular antigen-binding domain (e.g., scFv) comprises (a) a light chain variable region comprising amino acids having a sequence set forth in SEQ ID NO:19, and (b) a heavy chain variable region comprising amino acids having a sequence set forth in SEQ ID NO:20.

In certain embodiments, the extracellular antigen-binding domain (e.g., scFv) comprises (a) a light chain variable region comprising amino acids having a sequence set forth in SEQ ID NO:23, and (b) a heavy chain variable region comprising amino acids having a sequence set forth in SEQ ID NO:24.

In certain embodiments, the extracellular antigen-binding domain (e.g., scFv) comprises (a) a light chain variable region comprising amino acids having a sequence set forth in SEQ ID NO:27, and (b) a heavy chain variable region comprising amino acids having a sequence set forth in SEQ ID NO:28.

In certain embodiments, the extracellular antigen-binding domain (e.g., scFv) comprises (a) a light chain variable region comprising amino acids having a sequence set forth in SEQ ID NO:31, and (b) a heavy chain variable region comprising amino acids having a sequence set forth in SEQ ID NO:32.

In certain embodiments, the extracellular antigen-binding domain (e.g., scFv) comprises (a) a light chain variable region comprising amino acids having a sequence set forth in SEQ ID NO:35, and (b) a heavy chain variable region comprising amino acids having a sequence set forth in SEQ ID NO:36.

In certain embodiments, the extracellular antigen-binding domain (e.g., scFv) comprises (a) a light chain variable region comprising amino acids having a sequence set forth in SEQ ID NO:39, and (b) a heavy chain variable region comprising amino acids having a sequence set forth in SEQ ID NO:40.

In certain embodiments, the extracellular antigen-binding domain (e.g., scFv) comprises (a) a light chain variable region comprising amino acids having a sequence set forth in SEQ ID NO:43, and (b) a heavy chain variable region comprising amino acids having a sequence set forth in SEQ ID NO:44.

In certain embodiments, the extracellular antigen-binding domain (e.g., scFv) comprises (a) a light chain variable region comprising amino acids having a sequence set forth in SEQ ID NO:47, and (b) a heavy chain variable region comprising amino acids having a sequence set forth in SEQ ID NO:48.

In certain embodiments, the extracellular antigen-binding domain (e.g., scFv) comprises (a) a light chain variable region comprising amino acids having a sequence set forth in SEQ ID NO:51, and (b) a heavy chain variable region comprising amino acids having a sequence set forth in SEQ ID NO:52.

In certain embodiments, the extracellular antigen-binding domain (e.g., scFv) comprises (a) a light chain variable region comprising amino acids having a sequence set forth in SEQ ID NO:55, and (b) a heavy chain variable region comprising amino acids having a sequence set forth in SEQ ID NO:56.

In certain embodiments, the extracellular antigen-binding domain (e.g., scFv) comprises (a) a light chain variable region comprising amino acids having a sequence set forth in SEQ ID NO:59, and (b) a heavy chain variable region comprising amino acids having a sequence set forth in SEQ ID NO:60.

In certain embodiments, the extracellular antigen-binding domain (e.g., scFv) comprises (a) a light chain variable region comprising amino acids having a sequence set forth in SEQ ID NO:63, and (b) a heavy chain variable region comprising amino acids having a sequence set forth in SEQ ID NO:64.

In certain embodiments, the extracellular antigen-binding domain (e.g., scFv) comprises (a) a light chain variable region comprising amino acids having a sequence set forth in SEQ ID NO:67, and (b) a heavy chain variable region comprising amino acids having a sequence set forth in SEQ ID NO:68.

In certain embodiments, the extracellular antigen-binding domain (e.g., scFv) comprises (a) a light chain variable region comprising amino acids having a sequence set forth in SEQ ID NO:71, and (b) a heavy chain variable region comprising amino acids having a sequence set forth in SEQ ID NO:72.

In certain embodiments, the extracellular antigen-binding domain (e.g., scFv) comprises (a) a light chain variable region comprising amino acids having a sequence set forth in SEQ ID NO:75, and (b) a heavy chain variable region comprising amino acids having a sequence set forth in SEQ ID NO:76.

In certain embodiments, the extracellular antigen-binding domain (e.g., scFv) comprises (a) a light chain variable region comprising amino acids having a sequence set forth in SEQ ID NO:79, and (b) a heavy chain variable region comprising amino acids having a sequence set forth in SEQ ID NO:80.

In certain embodiments, the extracellular antigen-binding domain (e.g., scFv) comprises (a) a light chain variable region comprising amino acids having a sequence set forth in SEQ ID NO:83, and (b) a heavy chain variable region comprising amino acids having a sequence set forth in SEQ ID NO:84.

In certain embodiments, the extracellular antigen-binding domain (e.g., scFv) comprises (a) a light chain variable region comprising amino acids having a sequence set forth in SEQ ID NO:87, and (b) a heavy chain variable region comprising amino acids having a sequence set forth in SEQ ID NO:88.

In certain embodiments, the extracellular antigen-binding domain (e.g., scFv) comprises (a) a light chain variable region comprising amino acids having a sequence set forth in SEQ ID NO:91, and (b) a heavy chain variable region comprising amino acids having a sequence set forth in SEQ ID NO:92.

In certain embodiments, the extracellular antigen-binding domain (e.g., scFv) comprises (a) a light chain variable region comprising amino acids having a sequence set forth in SEQ ID NO:95, and (b) a heavy chain variable region comprising amino acids having a sequence set forth in SEQ ID NO:96.

In certain embodiments, the extracellular antigen-binding domain (e.g., scFv) comprises (a) a light chain variable region comprising amino acids having a sequence set forth in SEQ ID NO:99, and (b) a heavy chain variable region comprising amino acids having a sequence set forth in SEQ ID NO:100.

In certain embodiments, the extracellular antigen-binding domain (e.g., scFv) comprises (a) a light chain variable region comprising amino acids having a sequence set forth in SEQ ID NO:103, and (b) a heavy chain variable region comprising amino acids having a sequence set forth in SEQ ID NO:104.

In certain embodiments, the extracellular antigen-binding domain (e.g., scFv) comprises (a) a light chain variable region comprising amino acids having a sequence set forth in SEQ ID NO:107, and (b) a heavy chain variable region comprising amino acids having a sequence set forth in SEQ ID NO:108.

In certain embodiments, the extracellular antigen-binding domain (e.g., scFv) comprises (a) a light chain variable region comprising amino acids having a sequence set forth in SEQ ID NO:111, and (b) a heavy chain variable region comprising amino acids having a sequence set forth in SEQ ID NO:112.

In certain embodiments, the extracellular antigen-binding domain (e.g., scFv) comprises (a) a light chain variable region comprising amino acids having a sequence set forth in SEQ ID NO:115, and (b) a heavy chain variable region comprising amino acids having a sequence set forth in SEQ ID NO:116.

In certain embodiments, the extracellular antigen-binding domain (e.g., scFv) comprises (a) a light chain variable region comprising amino acids having a sequence set forth in SEQ ID NO:119, and (b) a heavy chain variable region comprising amino acids having a sequence set forth in SEQ ID NO:120.

In certain embodiments, the extracellular antigen-binding domain (e.g., scFv) comprises (a) a light chain variable region comprising amino acids having a sequence set forth in SEQ ID NO:123, and (b) a heavy chain variable region comprising amino acids having a sequence set forth in SEQ ID NO:124.

In certain embodiments, the extracellular antigen-binding domain (e.g., scFv) comprises (a) a light chain variable region comprising amino acids having a sequence set forth in SEQ ID NO:127, and (b) a heavy chain variable region comprising amino acids having a sequence set forth in SEQ ID NO:128.

In certain embodiments, the extracellular antigen-binding domain (e.g., scFv) comprises (a) a light chain variable region comprising amino acids having a sequence set forth in SEQ ID NO:131, and (b) a heavy chain variable region comprising amino acids having a sequence set forth in SEQ ID NO:132.

In certain embodiments, the extracellular antigen-binding domain (e.g., scFv) comprises (a) a light chain variable region comprising amino acids having a sequence set forth in SEQ ID NO:135, and (b) a heavy chain variable region comprising amino acids having a sequence set forth in SEQ ID NO:136.

In certain embodiments, the extracellular antigen-binding domain (e.g., scFv) comprises (a) a light chain variable region comprising amino acids having a sequence set forth in SEQ ID NO:139, and (b) a heavy chain variable region comprising amino acids having a sequence set forth in SEQ ID NO:140.

In certain embodiments, the extracellular antigen-binding domain (e.g., scFv) comprises (a) a light chain variable region comprising amino acids having a sequence set forth in SEQ ID NO:143, and (b) a heavy chain variable region comprising amino acids having a sequence set forth in SEQ ID NO:144.

In certain embodiments, the extracellular antigen-binding domain (e.g., scFv) comprises (a) a light chain variable region comprising amino acids having a sequence set forth in SEQ ID NO:147, and (b) a heavy chain variable region comprising amino acids having a sequence set forth in SEQ ID NO:148.

In certain embodiments, the extracellular antigen-binding domain (e.g., scFv) comprises (a) a light chain variable region comprising amino acids having a sequence set forth in SEQ ID NO:151, and (b) a heavy chain variable region comprising amino acids having a sequence set forth in SEQ ID NO:152.

In certain embodiments, the extracellular antigen-binding domain (e.g., scFv) comprises (a) a light chain variable region comprising amino acids having a sequence set forth in SEQ ID NO:155, and (b) a heavy chain variable region comprising amino acids having a sequence set forth in SEQ ID NO:156.

In certain embodiments, the extracellular antigen-binding domain (e.g., scFv) comprises (a) a light chain variable region comprising amino acids having a sequence set forth in SEQ ID NO:159, and (b) a heavy chain variable region comprising amino acids having a sequence set forth in SEQ ID NO:160.

In certain embodiments, the extracellular antigen-binding domain (e.g., scFv) comprises (a) a light chain variable region comprising amino acids having a sequence set forth in SEQ ID NO:163, and (b) a heavy chain variable region comprising amino acids having a sequence set forth in SEQ ID NO:164.

In certain embodiments, the extracellular antigen-binding domain (e.g., scFv) comprises (a) a light chain variable region comprising amino acids having a sequence set forth in SEQ ID NO:167, and (b) a heavy chain variable region comprising amino acids having a sequence set forth in SEQ ID NO:168.

In certain embodiments, the extracellular antigen-binding domain (e.g., scFv) comprises (a) a light chain variable region comprising amino acids having a sequence set forth in SEQ ID NO:171, and (b) a heavy chain variable region comprising amino acids having a sequence set forth in SEQ ID NO:172.

In certain embodiments, the extracellular antigen-binding domain (e.g., scFv) comprises (a) a light chain variable region comprising amino acids having a sequence set forth in SEQ ID NO:175, and (b) a heavy chain variable region comprising amino acids having a sequence set forth in SEQ ID NO:176.

In certain embodiments, the extracellular antigen-binding domain (e.g., scFv) comprises (a) a light chain variable region comprising amino acids having a sequence set forth in SEQ ID NO:179, and (b) a heavy chain variable region comprising amino acids having a sequence set forth in SEQ ID NO:180.

In certain embodiments, the extracellular antigen-binding domain (e.g., scFv) comprises (a) a light chain variable region comprising amino acids having a sequence set forth in SEQ ID NO:183, and (b) a heavy chain variable region comprising amino acids having a sequence set forth in SEQ ID NO:184.

In certain embodiments, the extracellular antigen-binding domain (e.g., scFv) comprises (a) a light chain variable region comprising amino acids having a sequence set forth in SEQ ID NO:187, and (b) a heavy chain variable region comprising amino acids having a sequence set forth in SEQ ID NO:188.

In certain embodiments, the extracellular antigen-binding domain (e.g., scFv) comprises (a) a light chain variable region comprising amino acids having a sequence set forth in SEQ ID NO:191, and (b) a heavy chain variable region comprising amino acids having a sequence set forth in SEQ ID NO:192.

In certain embodiments, the extracellular antigen-binding domain (e.g., scFv) comprises (a) a light chain variable region comprising amino acids having a sequence set forth in SEQ ID NO:195, and (b) a heavy chain variable region comprising amino acids having a sequence set forth in SEQ ID NO:196.

In certain embodiments, the extracellular antigen-binding domain (e.g., scFv) comprises (a) a light chain variable region comprising amino acids having a sequence set forth in SEQ ID NO:199, and (b) a heavy chain variable region comprising amino acids having a sequence set forth in SEQ ID NO:200.

In certain embodiments, the extracellular antigen-binding domain (e.g., scFv) comprises (a) a light chain variable region comprising amino acids having a sequence set forth in SEQ ID NO:203, and (b) a heavy chain variable region comprising amino acids having a sequence set forth in SEQ ID NO:204.

In certain embodiments, the extracellular antigen-binding domain (e.g., scFv) comprises (a) a light chain variable region comprising amino acids having a sequence set forth in SEQ ID NO:207, and (b) a heavy chain variable region comprising amino acids having a sequence set forth in SEQ ID NO:208.

In certain embodiments, the extracellular antigen-binding domain (e.g., scFv) comprises (a) a light chain variable region comprising amino acids having a sequence set forth in SEQ ID NO:211, and (b) a heavy chain variable region comprising amino acids having a sequence set forth in SEQ ID NO:212.

In certain embodiments, the extracellular antigen-binding domain (e.g., scFv) comprises (a) a light chain variable region comprising amino acids having a sequence set forth in SEQ ID NO:215, and (b) a heavy chain variable region comprising amino acids having a sequence set forth in SEQ ID NO:216.

In certain embodiments, the extracellular antigen-binding domain (e.g., scFv) comprises (a) a light chain variable region comprising amino acids having a sequence set forth in SEQ ID NO:219, and (b) a heavy chain variable region comprising amino acids having a sequence set forth in SEQ ID NO:220.

In certain embodiments, the extracellular antigen-binding domain (e.g., scFv) comprises (a) a light chain variable region comprising amino acids having a sequence set forth in SEQ ID NO:223, and (b) a heavy chain variable region comprising amino acids having a sequence set forth in SEQ ID NO:224.

In certain embodiments, the extracellular antigen-binding domain (e.g., scFv) comprises (a) a light chain variable region comprising amino acids having a sequence set forth in SEQ ID NO:227, and (b) a heavy chain variable region comprising amino acids having a sequence set forth in SEQ ID NO:228.

In certain embodiments, the extracellular antigen-binding domain (e.g., scFv) comprises (a) a light chain variable region comprising amino acids having a sequence set forth in SEQ ID NO:231, and (b) a heavy chain variable region comprising amino acids having a sequence set forth in SEQ ID NO:232.

In certain embodiments, the extracellular antigen-binding domain (e.g., scFv) comprises (a) a light chain variable region comprising amino acids having a sequence set forth in SEQ ID NO:235, and (b) a heavy chain variable region comprising amino acids having a sequence set forth in SEQ ID NO:236.

In certain embodiments, the extracellular antigen-binding domain (e.g., scFv) comprises (a) a light chain variable region comprising amino acids having a sequence set forth in SEQ ID NO:239, and (b) a heavy chain variable region comprising amino acids having a sequence set forth in SEQ ID NO:240.

In certain embodiments, the extracellular antigen-binding domain (e.g., scFv) comprises (a) a light chain variable region comprising amino acids having a sequence set forth in SEQ ID NO:243, and (b) a heavy chain variable region comprising amino acids having a sequence set forth in SEQ ID NO:244.

In certain embodiments, the extracellular antigen-binding domain (e.g., scFv) comprises (a) a light chain variable region comprising amino acids having a sequence set forth in SEQ ID NO:247, and (b) a heavy chain variable region comprising amino acids having a sequence set forth in SEQ ID NO:248.

In certain embodiments, the extracellular antigen-binding domain (e.g., scFv) comprises (a) a light chain variable region comprising amino acids having a sequence set forth in SEQ ID NO:251, and (b) a heavy chain variable region comprising amino acids having a sequence set forth in SEQ ID NO:252.

In certain embodiments, the extracellular antigen-binding domain (e.g., scFv) comprises (a) a light chain variable region comprising amino acids having a sequence set forth in SEQ ID NO:255, and (b) a heavy chain variable region comprising amino acids having a sequence set forth in SEQ ID NO:256.

In certain embodiments, the extracellular antigen-binding domain (e.g., scFv) comprises (a) a light chain variable region comprising amino acids having a sequence set forth in SEQ ID NO:259, and (b) a heavy chain variable region comprising amino acids having a sequence set forth in SEQ ID NO:260.

In certain embodiments, the extracellular antigen-binding domain (e.g., scFv) comprises (a) a light chain variable region comprising amino acids having a sequence set forth in SEQ ID NO:263, and (b) a heavy chain variable region comprising amino acids having a sequence set forth in SEQ ID NO:264.

In certain embodiments, the extracellular antigen-binding domain (e.g., scFv) comprises (a) a light chain variable region comprising amino acids having a sequence set forth in SEQ ID NO:267, and (b) a heavy chain variable region comprising amino acids having a sequence set forth in SEQ ID NO:268.

In certain embodiments, the extracellular antigen-binding domain (e.g., scFv) comprises (a) a light chain variable region comprising amino acids having a sequence set forth in SEQ ID NO:271, and (b) a heavy chain variable region comprising amino acids having a sequence set forth in SEQ ID NO:272.

In certain embodiments, the extracellular antigen-binding domain (e.g., scFv) comprises (a) a light chain variable region comprising amino acids having a sequence set forth in SEQ ID NO:275, and (b) a heavy chain variable region comprising amino acids having a sequence set forth in SEQ ID NO:276.

In certain embodiments, the extracellular antigen-binding domain (e.g., scFv) comprises (a) a light chain variable region comprising amino acids having a sequence set forth in SEQ ID NO:279, and (b) a heavy chain variable region comprising amino acids having a sequence set forth in SEQ ID NO:280.

In certain embodiments, the extracellular antigen-binding domain (e.g., scFv) comprises (a) a light chain variable region comprising amino acids having a sequence set forth in SEQ ID NO:283, and (b) a heavy chain variable region comprising amino acids having a sequence set forth in SEQ ID NO:284.

In certain embodiments, the extracellular antigen-binding domain (e.g., scFv) comprises (a) a light chain variable region comprising amino acids having a sequence set forth in SEQ ID NO:287, and (b) a heavy chain variable region comprising amino acids having a sequence set forth in SEQ ID NO:288.

In certain embodiments, the extracellular antigen-binding domain (e.g., scFv) comprises (a) a light chain variable region comprising amino acids having a sequence set forth in SEQ ID NO:291, and (b) a heavy chain variable region comprising amino acids having a sequence set forth in SEQ ID NO:292.

In certain embodiments, the extracellular antigen-binding domain (e.g., scFv) comprises (a) a light chain variable region comprising amino acids having a sequence set forth in SEQ ID NO:279, and (b) a heavy chain variable region comprising amino acids having a sequence set forth in SEQ ID NO:280.

In certain embodiments, the extracellular antigen-binding domain (e.g., scFv) comprises (a) a light chain variable region comprising amino acids having a sequence set forth in SEQ ID NO:283, and (b) a heavy chain variable region comprising amino acids having a sequence set forth in SEQ ID NO:284.

In certain embodiments, the extracellular antigen-binding domain (e.g., scFv) comprises (a) a light chain variable region comprising amino acids having a sequence set forth in SEQ ID NO:287, and (b) a heavy chain variable region comprising amino acids having a sequence set forth in SEQ ID NO:288.

In certain embodiments, the extracellular antigen-binding domain (e.g., scFv) comprises (a) a light chain variable region comprising amino acids having a sequence set forth in SEQ ID NO:291, and (b) a heavy chain variable region comprising amino acids having a sequence set forth in SEQ ID NO:292.

In certain embodiments, the extracellular antigen-binding domain (e.g., scFv) comprises (a) a light chain variable region comprising amino acids having a sequence set forth in SEQ ID NO:295, and (b) a heavy chain variable region comprising amino acids having a sequence set forth in SEQ ID NO:296.

In certain embodiments, the extracellular antigen-binding domain (e.g., scFv) comprises (a) a light chain variable region comprising amino acids having a sequence set forth in SEQ ID NO:299, and (b) a heavy chain variable region comprising amino acids having a sequence set forth in SEQ ID NO:300.

In certain embodiments, the extracellular antigen-binding domain (e.g., scFv) comprises (a) a light chain variable region comprising amino acids having a sequence set forth in SEQ ID NO:303, and (b) a heavy chain variable region comprising amino acids having a sequence set forth in SEQ ID NO:304.

In certain embodiments, the extracellular antigen-binding domain (e.g., scFv) comprises (a) a heavy chain variable region comprising amino acids having the sequence set forth in SEQ ID NO:915, and (b) a light chain variable region comprising amino acids having the sequence set forth in SEQ ID NO:917.

In certain embodiments, the extracellular antigen-binding domain (e.g., scFv) comprises (a) a heavy chain variable region comprising amino acids having the sequence set forth in SEQ ID NO:919, and (b) a light chain variable region comprising amino acids having the sequence set forth in SEQ ID NO:921.

In certain embodiments, the extracellular antigen-binding domain (e.g., scFv) comprises heavy and light chain variable regions comprising amino acid sequences that are homologous to the amino acid sequences described herein and as disclosed in Tables 1-76. For example, and not by way of limitation, the extracellular antigen-binding domain (e.g., scFv) comprises a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299, SEQ ID NO:303, SEQ ID NO:917 and SEQ ID NO:921.

In certain embodiments, the extracellular antigen-binding domain (e.g., scFv) comprises a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300, SEQ ID NO:304, SEQ ID NO:915 and SEQ ID NO:919.

In certain embodiments, the extracellular antigen-binding domain (e.g., scFv) comprises (a) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:3, SEQ ID NO:7, SEQ ID NO:11, SEQ ID NO:15, SEQ ID NO:19, SEQ ID NO:23, SEQ ID NO:27, SEQ ID NO:31, SEQ ID NO:35, SEQ ID NO:39, SEQ ID NO:43, SEQ ID NO:47, SEQ ID NO:51, SEQ ID NO:55, SEQ ID NO:59, SEQ ID NO:63, SEQ ID NO:67, SEQ ID NO:71, SEQ ID NO:75, SEQ ID NO:79, SEQ ID NO:83, SEQ ID NO:87, SEQ ID NO:91, SEQ ID NO:95, SEQ ID NO:99, SEQ ID NO:103, SEQ ID NO:107, SEQ ID NO:111, SEQ ID NO:115, SEQ ID NO:119, SEQ ID NO:123, SEQ ID NO:127, SEQ ID NO:131, SEQ ID NO:135, SEQ ID NO:139, SEQ ID NO:143, SEQ ID NO:147, SEQ ID NO:151, SEQ ID NO:155, SEQ ID NO:159, SEQ ID NO:163, SEQ ID NO:167, SEQ ID NO:171, SEQ ID NO:175, SEQ ID NO:179, SEQ ID NO:183, SEQ ID NO:187, SEQ ID NO:191, SEQ ID NO:195, SEQ ID NO:199, SEQ ID NO:203, SEQ ID NO:207, SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO:275, SEQ ID NO:279, SEQ ID NO:283, SEQ ID NO:287, SEQ ID NO:291, SEQ ID NO:295, SEQ ID NO:299, SEQ ID NO:303, SEQ ID NO:917 and SEQ ID NO:921; and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to an amino acid sequence selected from the group consisting of SEQ ID NO:4, SEQ ID NO:8, SEQ ID NO:12, SEQ ID NO:16, SEQ ID NO:20, SEQ ID NO:24, SEQ ID NO:28, SEQ ID NO:32, SEQ ID NO:36, SEQ ID NO:40, SEQ ID NO:44, SEQ ID NO:48, SEQ ID NO:52, SEQ ID NO:56, SEQ ID NO:60, SEQ ID NO:64, SEQ ID NO:68, SEQ ID NO:72, SEQ ID NO:76, SEQ ID NO:80, SEQ ID NO:84, SEQ ID NO:88, SEQ ID NO:92, SEQ ID NO:96, SEQ ID NO:100, SEQ ID NO:104, SEQ ID NO:108, SEQ ID NO:112, SEQ ID NO:116, SEQ ID NO:120, SEQ ID NO:124, SEQ ID NO:128, SEQ ID NO:132, SEQ ID NO:136, SEQ ID NO:140, SEQ ID NO:144, SEQ ID NO:148, SEQ ID NO:152, SEQ ID NO:156, SEQ ID NO:160, SEQ ID NO:164, SEQ ID NO:168, SEQ ID NO:172, SEQ ID NO:176, SEQ ID NO:180, SEQ ID NO:184, SEQ ID NO:188, SEQ ID NO:192, SEQ ID NO:196, SEQ ID NO:200, SEQ ID NO:204, SEQ ID NO:208, SEQ ID NO:212, SEQ ID NO:216, SEQ ID NO:220, SEQ ID NO:224, SEQ ID NO:228, SEQ ID NO:232, SEQ ID NO:236, SEQ ID NO:240, SEQ ID NO:244, SEQ ID NO:248, SEQ ID NO:252, SEQ ID NO:256, SEQ ID NO:260, SEQ ID NO:264, SEQ ID NO:268, SEQ ID NO:272, SEQ ID NO:276, SEQ ID NO:280, SEQ ID NO:284, SEQ ID NO:288, SEQ ID NO:292, SEQ ID NO:296, SEQ ID NO:300, SEQ ID NO:304, SEQ ID NO:915 and SEQ ID NO:919.

In certain embodiments, the extracellular antigen-binding domain (e.g., scFv) comprises (a) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:143, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:144, wherein the extracellular antigen-binding domain binds to an FcRL5 polypeptide.

In certain embodiments, the extracellular antigen-binding domain (e.g., scFv) comprises (a) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:215, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:216, wherein the extracellular antigen-binding domain binds to an FcRL5 polypeptide.

In certain embodiments, the extracellular antigen-binding domain (e.g., scFv) comprises (a) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:219, and (b) a heavy chain variable comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:220, wherein the extracellular antigen-binding domain binds to an FcRL5 polypeptide.

In certain embodiments, the extracellular antigen-binding domain (e.g., scFv) comprises (a) a light chain variable comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:235, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:236, wherein the extracellular antigen-binding domain binds to an FcRL5 polypeptide.

In certain embodiments, the extracellular antigen-binding domain (e.g., scFv) comprises (a) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:267, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:268, wherein the extracellular antigen-binding domain binds to an FcRL5 polypeptide.

In certain embodiments, the extracellular antigen-binding domain (e.g., scFv) comprises (a) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:915, and (b) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:917, wherein the extracellular antigen-binding domain binds to an FcRL5 polypeptide.

In certain embodiments, the extracellular antigen-binding domain (e.g., scFv) comprises (a) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:919, and (b) a light chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:921, wherein the extracellular antigen-binding domain binds to an FcRL5 polypeptide.

In certain embodiments, the extracellular antigen-binding domain (e.g., scFv) comprises (a) a light chain variable comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:115, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:116, wherein the extracellular antigen-binding domain binds to an FcRL5 polypeptide.

In certain embodiments, the extracellular antigen-binding domain (e.g., scFv) comprises (a) a light chain variable comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:171, and (b) a heavy chain variable region comprising an amino acid sequence that is at least 80%, 81%, 82%, 83%, 84%, 85%, 86%, 87%, 88%, 89%, 90%, 91%, 92%, 93%, 94%, 95%, 96%, 97%, 98% or 99% homologous to the amino acid sequence set forth in SEQ ID NO:172, wherein the extracellular antigen-binding domain binds to an FcRL5 polypeptide.

An extracellular antigen-binding domain (e.g., scFv) comprising $V_H$ and/or $V_L$ regions having high (i.e., 80% or greater) homology to the $V_H$ and $V_L$ regions of the sequences set forth above, can be obtained by mutagenesis (e.g., site-directed or PCR-mediated mutagenesis), followed by testing of the encoded altered scFv for retained function (i.e., the binding affinity) using the binding assays described herein. In certain embodiments, a $V_L$ sequence having at least 90%, 91%, 92%, 93%, 94%, 95%, 96%, 97%, 98% or 99% identity contains substitutions (e.g., conservative substitutions to generate conservative modifications of a sequence), insertions or deletions relative to the reference sequence, but an extracellular antigen-binding domain (e.g., scFv) comprising that sequence retains the ability to bind to FcRL5. In certain embodiments, a $V_H$ sequence having at least 90%, 91%, 92%, 93%, 94%, 95%, 96%, 97%, 98%, or 99% identity contains substitutions (e.g., conservative substitutions), insertions or deletions relative to the reference sequence, but an extracellular antigen-binding domain (e.g., scFv) comprising that sequence retains the ability to bind to FcRL5. In certain embodiments, a total of about 1 to about 10 amino acids have been substituted, inserted and/or deleted in the disclosed sequences. For example, and not by way of limitation, a $V_H$ sequence or a $V_L$ sequence, can have up to about one, up to about two, up to about three, up to about four, up to about five, up to about six, up to about seven, up to about eight, up to about nine or up to about ten amino acid residues that are modified and/or substituted. Non-limiting examples of conservative modifications are provided below, e.g., within Table 231.

The presently disclosed subject matter further provides extracellular antigen-binding domains (e.g., scFv) that comprise heavy chain variable region and light chain variable region CDRs, e.g., CDR1s, CDR2s and CDR3s, as disclosed herein in Tables 229 and 230. The CDR regions are delineated using the Kabat system (Kabat, E. A., et al. (1991) Sequences of Proteins of Immunological Interest, Fifth Edition, U.S. Department of Health and Human Services, NIH Publication No. 91-3242). The present disclosure further provides extracellular antigen-binding domains (e.g., scFv) that comprise conservative modifications of the antibody sequences disclosed herein. For example, and not by way of limitation, an extracellular antigen-binding domains (e.g., scFv) of the presently disclosed subject matter comprises a heavy chain variable region comprising CDR1, CDR2 and CDR3 sequences and a light chain variable region comprising CDR1, CDR2 and CDR3 sequences, wherein one or more of these CDR sequences comprise specified amino acid sequences disclosed herein, or conservative modifications thereof, and wherein the extracellular antigen-binding domains retain the desired functional properties. See Tables 229 and 230.

In certain embodiments, the presently disclosed subject matter provides an extracellular antigen-binding domain (e.g., scFv) comprising a light chain variable region, wherein the light chain variable region comprises: (a) a CDR1 comprising an amino acid sequence selected from the group consisting of SEQ ID NOs: 312, 3118, 324, 329, 338, 343, 348, 352, 357, 363, 369, 381, 390, 397, 401, 406, 416, 423, 428, 433, 447, 460, 468, 474, 477, 483, 490, 498, 503, 508, 518, 533, 540, 544, 547, 556, 562, 568, 571, 580, 585, 588, 926 and 932, and conservative modifications thereof (b) a CDR2 comprising an amino acid sequence selected from the group consisting of SEQ ID NOs:313, 319, 330, 344, 349, 358, 364, 370, 382, 385, 391, 398, 409, 417, 429, 434, 438, 448, 454, 461, 469, 478, 484, 487, 504, 513, 523, 534, 429, 448, 548, 557, 563, 572, 575, 586, 927 and 933, and conservative modifications thereof; and (c) a CDR3 comprising an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581, 592, 928 and 934, and conservative modifications thereof.

In certain embodiments, the extracellular antigen-binding domain (e.g., scFv) comprises a heavy chain variable region, wherein the heavy chain variable region comprises: (a) a CDR1 comprising an amino acid sequence selected from the group consisting of SEQ ID NOs: 309, 315, 321, 326, 332, 335, 340, 346, 354, 360, 366, 372, 378, 387, 393, 403, 411, 420, 425, 436, 440, 444, 471, 480, 500, 510, 515, 520, 525, 537, 551, 559, 565, 582, 589, 923 and 929 and conservative modifications thereof (b) a CDR2 comprising an amino acid sequence selected from the group consisting of SEQ ID NOs: 310, 316, 322, 327, 333, 336, 341, 355, 361, 367, 373, 379, 388, 404, 412, 421, 426, 431, 441, 445, 450, 466, 472, 475, 481, 496, 501, 506, 511, 516, 521, 526, 538, 552, 560, 566, 583, 590, 924 and 930 and conservative modifications thereof; and (c) a CDR3 comprising an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587, 591, 925 and 931, and conservative modifications thereof.

In certain embodiments, the extracellular antigen-binding domain (e.g., scFv) comprises (a) a heavy chain variable region CDR1 comprising the amino acid sequence of SEQ ID NO:411 or conservative modifications thereof; (b) a heavy chain variable region CDR2 comprising the amino acid sequence of SEQ ID NO:412 or conservative modifications thereof and (c) a heavy chain variable region CDR3 comprising the amino acid sequence of SEQ ID NO:463 or conservative modifications thereof. In certain embodiments, the extracellular antigen-binding domain (e.g., scFv) comprises (a) a light chain variable region CDR1 comprising the amino acid sequence of SEQ ID NO:318 or conservative modifications thereof; (b) a light chain variable region CDR2 comprising the amino acid sequence of SEQ ID NO:319 or conservative modifications thereof; and (c) a light chain variable region CDR3 comprising the amino acid sequence of SEQ ID NO:419 or conservative modifications thereof.

In certain embodiments, the extracellular antigen-binding domain (e.g., scFv) comprises (a) a heavy chain variable region CDR1 comprising the amino acid sequence of SEQ ID NO:515 or conservative modifications thereof; (b) a heavy chain variable region CDR2 comprising the amino acid sequence of SEQ ID NO:516 or conservative modifications thereof; and (c) a heavy chain variable region CDR3 comprising the amino acid sequence of SEQ ID NO:517 or conservative modifications thereof. In certain embodiments, the extracellular antigen-binding domain (e.g., scFv) comprises (a) a light chain variable region CDR1 comprising the amino acid sequence of SEQ ID NO:318 or conservative modifications thereof; (b) a light chain variable region CDR2 comprising the amino acid sequence of SEQ ID NO:319 or conservative modifications thereof; and (c) a light chain variable region CDR3 comprising the amino acid sequence of SEQ ID NO:531 or conservative modifications thereof.

In certain embodiments, the extracellular antigen-binding domain (e.g., scFv) comprises (a) a heavy chain variable region CDR1 comprising the amino acid sequence of SEQ ID NO:403 or conservative modifications thereof; (b) a heavy chain variable region CDR2 comprising the amino acid sequence of SEQ ID NO:404 or conservative modifications thereof and (c) a heavy chain variable region CDR3 comprising the amino acid sequence of SEQ ID NO:532 or conservative modifications thereof. In certain embodiments, the extracellular antigen-binding domain (e.g., scFv) comprises (a) a light chain variable region CDR1 comprising the amino acid sequence of SEQ ID NO:533 or conservative modifications thereof; (b) a light chain variable region CDR2 comprising the amino acid sequence of SEQ ID NO:534 or conservative modifications thereof; and (c) a light chain variable region CDR3 comprising the amino acid sequence of SEQ ID NO:535 or conservative modifications thereof.

In certain embodiments, the extracellular antigen-binding domain (e.g., scFv) comprises (a) a heavy chain variable region CDR1 comprising the amino acid sequence of SEQ ID NO:411 or conservative modifications thereof; (b) a heavy chain variable region CDR2 comprising the amino acid sequence of SEQ ID NO:412 or conservative modifications thereof; and (c) a heavy chain variable region CDR3 comprising the amino acid sequence of SEQ ID NO:543 or conservative modifications thereof. In certain embodiments, the extracellular antigen-binding domain (e.g., scFv) comprises (a) a light chain variable region CDR1 comprising the amino acid sequence of SEQ ID NO:544 or conservative modifications thereof (b) a light chain variable region CDR2 comprising the amino acid sequence of SEQ ID NO:448 or conservative modifications thereof; and (c) a light chain variable region CDR3 comprising the amino acid sequence of SEQ ID NO:545 or conservative modifications thereof.

In certain embodiments, the extracellular antigen-binding domain (e.g., scFv) comprises (a) a heavy chain variable region CDR1 comprising the amino acid sequence of SEQ ID NO:372 or conservative modifications thereof; (b) a heavy chain variable region CDR2 comprising the amino acid sequence of SEQ ID NO:475 or conservative modifications thereof and (c) a heavy chain variable region CDR3 comprising the amino acid sequence of SEQ ID NO:570 or conservative modifications thereof. In certain embodiments, the extracellular antigen-binding domain (e.g., scFv) comprises (a) a light chain variable region CDR1 comprising the amino acid sequence of SEQ ID NO:571 or conservative modifications thereof; (b) a light chain variable region CDR2 comprising the amino acid sequence of SEQ ID NO:572 or conservative modifications thereof; and (c) a light chain variable region CDR3 comprising the amino acid sequence of SEQ ID NO:573 or conservative modifications thereof.

In certain embodiments, the extracellular antigen-binding domain (e.g., scFv) comprises (a) a heavy chain variable region CDR1 comprising the amino acid sequence of SEQ ID NO:440 or conservative modifications thereof; (b) a heavy chain variable region CDR2 comprising the amino acid sequence of SEQ ID NO:441 or conservative modifications thereof; and (c) a heavy chain variable region CDR3 comprising the amino acid sequence of SEQ ID NO:442 or conservative modifications thereof. In certain embodiments, the extracellular antigen-binding domain (e.g., scFv) comprises (a) a light chain variable region CDR1 comprising the amino acid sequence of SEQ ID NO:329 or conservative modifications thereof; (b) a light chain variable region CDR2 comprising the amino acid sequence of SEQ ID NO:330 or conservative modifications thereof; and (c) a light chain variable region CDR3 comprising the amino acid sequence of SEQ ID NO:443 or conservative modifications thereof.

In certain embodiments, the extracellular antigen-binding domain (e.g., scFv) comprises (a) a heavy chain variable region CDR1 comprising the amino acid sequence of SEQ ID NO:309 or conservative modifications thereof; (b) a heavy chain variable region CDR2 comprising the amino acid sequence of SEQ ID NO:310 or conservative modifications thereof; and (c) a heavy chain variable region CDR3 comprising the amino acid sequence of SEQ ID NO:489 or conservative modifications thereof. In certain embodiments, the extracellular antigen-binding domain (e.g., scFv) comprises (a) a light chain variable region CDR1 comprising the amino acid sequence of SEQ ID NO:490 or conservative modifications thereof; (b) a light chain variable region CDR2 comprising the amino acid sequence of SEQ ID NO:313 or conservative modifications thereof; and (c) a light chain variable region CDR3 comprising the amino acid sequence of SEQ ID NO:491 or conservative modifications thereof.

In certain embodiments, the extracellular antigen-binding domain (e.g., scFv) comprises (a) a heavy chain variable region CDR1 comprising amino acids having the sequence set forth in SEQ ID NO:923 or conservative modifications thereof; (b) a heavy chain variable region CDR2 comprising amino acids having the sequence set forth in SEQ ID NO:924 or conservative modifications thereof; and (c) a heavy chain variable region CDR3 comprising amino acids having the sequence set forth in SEQ ID NO:925 or conservative modifications thereof. In certain embodiments, the extracellular antigen-binding domain comprises (a) a light chain variable region CDR1 comprising amino acids having the sequence set forth in SEQ ID NO:926 or conservative modifications thereof; (b) a light chain variable region CDR2 comprising amino acids having the sequence set forth in SEQ ID NO:927 or conservative modifications thereof; and (c) a light chain variable region CDR3 comprising amino acids having the sequence set forth in SEQ ID NO:928 or conservative modifications thereof.

In certain embodiments, the extracellular antigen-binding domain (e.g., scFv) comprises (a) a heavy chain variable region CDR1 comprising amino acids having the sequence set forth in SEQ ID NO:929 or conservative modifications thereof; (b) a heavy chain variable region CDR2 comprising amino acids having the sequence set forth in SEQ ID NO:930 or conservative modifications thereof; and (c) a heavy chain variable region CDR3 comprising amino acids having the sequence set forth in SEQ ID NO:931 or conservative modifications thereof. In certain embodiments, the extracellular antigen-binding domain comprises (a) a light chain variable region CDR1 comprising amino acids having the sequence set forth in SEQ ID NO:932 or conservative modifications thereof; (b) a light chain variable region CDR2 comprising amino acids having the sequence set forth in SEQ ID NO: 933 or conservative modifications thereof; and (c) a light chain variable region CDR3 comprising amino acids having the sequence set forth in SEQ ID NO:934 or conservative modifications thereof.

The presently disclosed subject matter provides an extracellular antigen-binding domain (e.g., scFv) comprising a heavy chain variable region comprising CDR1, CDR2, and CDR3 sequences and a light chain variable region comprising CDR1, CDR2, and CDR3 sequences, wherein: (a) the heavy chain variable region CDR3 comprises an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587, 591, 925 and 931, and conservative modifications thereof; and (b) the light chain variable region CDR3 comprises an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581, 592, 928 and 934 and conservative modifications thereof; wherein the extracellular antigen-binding domain specifically binds to human FcRL5.

In certain embodiments, the extracellular antigen-binding domain (e.g., scFv) comprises (a) a heavy chain variable region CDR3 comprising the amino acid sequence of SEQ ID NO:463 or conservative modifications thereof; and (b) a light chain variable region CDR3 comprising the amino acid sequence of SEQ ID NO:419 or conservative modifications thereof; wherein the extracellular antigen-binding domain specifically binds FcRL5.

In certain embodiments, the extracellular antigen-binding domain (e.g., scFv) comprises (a) a heavy chain variable region CDR3 comprising the amino acid sequence of SEQ ID NO:517 or conservative modifications thereof; and (b) a light chain variable region CDR3 comprising the amino acid sequence of SEQ ID NO:531 or conservative modifications thereof; wherein the extracellular antigen-binding domain specifically binds FcRL5.

In certain embodiments, the extracellular antigen-binding domain (e.g., scFv) comprises (a) a heavy chain variable region CDR3 comprising the amino acid sequence of SEQ ID NO:532 or conservative modifications thereof; and (b) a light chain variable region CDR3 comprising the amino acid sequence of SEQ ID NO:535 or conservative modifications thereof; wherein the antibody or antigen-binding fragment thereof specifically binds FcRL5.

In certain embodiments, the extracellular antigen-binding domain (e.g., scFv) comprises (a) a heavy chain variable region CDR3 comprising the amino acid sequence of SEQ ID NO:543 or conservative modifications thereof; and (b) a light chain variable region CDR3 comprising the amino acid sequence of SEQ ID NO:545 or conservative modifications thereof; wherein the extracellular antigen-binding domain specifically binds FcRL5.

In certain embodiments, the extracellular antigen-binding domain (e.g., scFv) comprises (a) a heavy chain variable region CDR3 comprising the amino acid sequence of SEQ ID NO:570 or conservative modifications thereof; and (b) a light chain variable region CDR3 comprising the amino acid sequence of SEQ ID NO:573 or conservative modifications thereof; wherein the antibody or antigen-binding fragment thereof specifically binds FcRL5.

In certain embodiments, the extracellular antigen-binding domain (e.g., scFv) comprises (a) a heavy chain variable region CDR3 comprising amino acids having the sequence set forth in SEQ ID NO:925 or conservative modifications thereof; and (b) and a light chain variable region CDR3 comprising amino acids having the sequence set forth in SEQ ID NO:928 or conservative modifications thereof; wherein the extracellular antigen-binding domain specifically binds FcRL5.

In certain embodiments, the extracellular antigen-binding domain (e.g., scFv) comprises (a) a heavy chain variable region CDR3 comprising amino acids having the sequence set forth in SEQ ID NO:931 or conservative modifications thereof; and (b) a light chain variable region CDR3 comprising amino acids having the sequence set forth in SEQ ID NO:934 or conservative modifications thereof.

In certain embodiments, the extracellular antigen-binding domain (e.g., scFv) comprises (a) a heavy chain variable region CDR3 comprising the amino acid sequence of SEQ ID NO:442 or conservative modifications thereof; and (b) a light chain variable region CDR3 comprising the amino acid sequence of SEQ ID NO:443 or conservative modifications thereof wherein the extracellular antigen-binding domain specifically binds FcRL5.

In certain embodiments, the extracellular antigen-binding domain (e.g., scFv) comprises (a) a heavy chain variable region CDR3 comprising the amino acid sequence of SEQ ID NO:489 or conservative modifications thereof; and (b) a light chain variable region CDR3 comprising the amino acid sequence of SEQ ID NO:491 or conservative modifications thereof wherein the extracellular antigen-binding domain specifically binds FcRL5.

In certain embodiments, the presently disclosed subject matter provides an extracellular antigen-binding domain (e.g., scFv) comprising a heavy chain variable region comprising CDR1, CDR2, and CDR3 sequences and a light chain variable region comprising CDR1, CDR2, and CDR3 sequences, wherein: (a) the heavy chain variable region CDR1 comprises an amino acid sequence selected from the group consisting of SEQ ID NOs: 309, 315, 321, 326, 332, 335, 340, 346, 354, 360, 366, 372, 378, 387, 393, 403, 411, 420, 425, 436, 440, 444, 471, 480, 500, 510, 515, 520, 525, 537, 551, 559, 565, 582, 589, 923 and 929, and conservative modifications thereof; (b) the heavy chain variable region CDR2 comprises an amino acid sequence selected from the group consisting of SEQ ID NOs: 310, 316, 322, 327, 333, 336, 341, 355, 361, 367, 373, 379, 388, 404, 412, 421, 426, 431, 441, 445, 450, 466, 472, 475, 481, 496, 501, 506, 511, 516, 521, 526, 538, 552, 560, 566, 583, 590, 924 and 930, and conservative modifications thereof; (c) the heavy chain variable region CDR3 comprises an amino acid sequence selected from the group consisting of SEQ ID NOs: 311, 317, 323, 328, 334, 337, 342, 347, 351, 356, 362, 368, 374, 376, 380, 384, 389, 394, 396, 400, 405, 408, 412, 415, 422, 427, 432, 437, 442, 446, 451, 453, 456, 458, 459, 463, 464, 467, 473, 476, 482, 486, 489, 492, 494, 497, 502, 507, 512, 517, 522, 527, 529, 532, 536, 539, 543, 546, 550, 553, 555, 561, 567, 570, 574, 577, 578, 579, 584, 578, 587, 591, 925 and 931 and conservative modifications thereof; (d) the light chain variable region CDR1 comprises an amino acid sequence selected from the group consisting of SEQ ID NOs: 312, 3118, 324, 329, 338, 343, 348, 352, 357, 363, 369, 381, 390, 397, 401, 406, 416, 423, 428, 433, 447, 460, 468, 474, 477, 483, 490, 498, 503, 508, 518, 533, 540, 544, 547, 556, 562, 568, 571, 580, 585, 588, 926 and 932 and conservative modifications thereof; (e) the light chain variable region CDR2 comprises an amino acid sequence selected from the group consisting of SEQ ID NOs:313, 319, 330, 344, 349, 358, 364, 370, 382, 385, 391, 398, 409, 417, 429, 434, 438, 448, 454, 461, 469, 478, 484, 487, 504, 513, 523, 534, 429, 448, 548, 557, 563, 572, 575, 586, 927 and 933 and conservative modifications thereof; and (f) the light chain variable region CDR3 comprises an amino acid sequence selected from the group consisting of SEQ ID NOs: 314, 320, 325, 331, 339, 345, 350, 353, 359, 365, 371, 377, 383, 386, 392, 395, 399, 402, 407, 410, 414, 418, 419, 424, 430, 435, 439, 443, 449, 452, 455, 457, 462, 465, 470, 479, 485, 488, 491, 493, 495, 499, 505, 509, 514, 519, 524, 528, 530, 531, 535, 541, 542, 545, 549, 554, 558, 564, 569, 573, 576, 581, 592, 928 and 934 and conservative modifications thereof; wherein the extracellular antigen-binding domain specifically binds FcRL5.

In certain embodiments, the extracellular antigen-binding domain (e.g., scFv) comprises (a) a heavy chain variable region CDR1 comprising the amino acid sequence of SEQ ID NO:411 or conservative modifications thereof; (b) a heavy chain variable region CDR2 comprising the amino acid sequence of SEQ ID NO:412 or conservative modifications thereof; (c) a heavy chain variable region CDR3 comprising the amino acid sequence of SEQ ID NO:463 or conservative modifications thereof; (d) a light chain variable region CDR1 comprising the amino acid sequence of SEQ ID NO:318 or conservative modifications thereof; (e) a light chain variable region CDR2 comprising the amino acid sequence of SEQ ID NO:319 or conservative modifications thereof; and (f) a light chain variable region CDR3 comprising the amino acid sequence of SEQ ID NO:419 or conservative modifications thereof.

In certain embodiments, the extracellular antigen-binding domain (e.g., scFv) comprises (a) a heavy chain variable region CDR1 comprising the amino acid sequence of SEQ ID NO:515 or conservative modifications thereof; (b) a heavy chain variable region CDR2 comprising the amino acid sequence of SEQ ID NO:516 or conservative modifications thereof; (c) a heavy chain variable region CDR3 comprising the amino acid sequence of SEQ ID NO:517 or conservative modifications thereof; (d) a light chain variable region CDR1 comprising the amino acid sequence of SEQ ID NO:318 or conservative modifications thereof; (e) a light chain variable region CDR2 comprising the amino acid sequence of SEQ ID NO:319 or conservative modifications thereof; and (f) a light chain variable region CDR3 comprising the amino acid sequence of SEQ ID NO:531 or conservative modifications thereof.

In certain embodiments, the extracellular antigen-binding domain (e.g., scFv) comprises (a) a heavy chain variable region CDR1 comprising the amino acid sequence of SEQ ID NO:403 or conservative modifications thereof; (b) a heavy chain variable region CDR2 comprising the amino acid sequence of SEQ ID NO:404 or conservative modifications thereof; (c) a heavy chain variable region CDR3 comprising the amino acid sequence of SEQ ID NO:532 or conservative modifications thereof; (d) a light chain variable region CDR1 comprising the amino acid sequence of SEQ ID NO:533 or conservative modifications thereof; (e) a light chain variable region CDR2 comprising the amino acid sequence of SEQ ID NO:534 or conservative modifications thereof; and (f) a light chain variable region CDR3 comprising the amino acid sequence of SEQ ID NO:535 or conservative modifications thereof.

In certain embodiments, the extracellular antigen-binding domain (e.g., scFv) comprises (a) a heavy chain variable region CDR1 comprising the amino acid sequence of SEQ ID NO:411 or conservative modifications thereof; (b) a heavy chain variable region CDR2 comprising the amino acid sequence of SEQ ID NO:412 or conservative modifications thereof; (c) a heavy chain variable region CDR3 comprising the amino acid sequence of SEQ ID NO:543 or conservative modifications thereof; (d) a light chain variable region CDR1 comprising the amino acid sequence of SEQ ID NO:544 or conservative modifications thereof; (e) a light chain variable region CDR2 comprising the amino acid sequence of SEQ ID NO:448 or conservative modifications thereof; and (f) a light chain variable region CDR3 comprising the amino acid sequence of SEQ ID NO:545 or conservative modifications thereof.

In certain embodiments, the extracellular antigen-binding domain (e.g., scFv) comprises (a) a heavy chain variable region CDR1 comprising the amino acid sequence of SEQ ID NO:372 or conservative modifications thereof; (b) a heavy chain variable region CDR2 comprising the amino acid sequence of SEQ ID NO:475 or conservative modifications thereof; (c) a heavy chain variable region CDR3 comprising the amino acid sequence of SEQ ID NO:570 or conservative modifications thereof; (d) a light chain variable region CDR1 comprising the amino acid sequence of SEQ ID NO:571 or conservative modifications thereof; (e) a light chain variable region CDR2 comprising the amino acid sequence of SEQ ID NO:572 or conservative modifications thereof; and (f) a light chain variable region CDR3 comprising the amino acid sequence of SEQ ID NO:573 or conservative modifications thereof.

In certain embodiments, the extracellular antigen-binding domain (e.g., scFv) comprises (a) a heavy chain variable region CDR1 comprising amino acids having the sequence set forth in SEQ ID NO:923 or conservative modifications thereof; (b) a heavy chain variable region CDR2 comprising amino acids having the sequence set forth in SEQ ID NO:924 or conservative modifications thereof; (c) a heavy chain variable region CDR3 comprising amino acids having the sequence set forth in SEQ ID NO:925 or conservative modifications thereof; (d) a light chain variable region CDR1 comprising amino acids having the sequence set forth in SEQ ID NO:926 or conservative modifications thereof; (e) a light chain variable region CDR2 comprising amino acids having the sequence set forth in SEQ ID NO:927 or conservative modifications thereof; and (f) and a light chain variable region CDR3 comprising amino acids having the sequence set forth in SEQ ID NO:928 or conservative modifications thereof.

In certain embodiments, the extracellular antigen-binding domain (e.g., scFv) comprises (a) a heavy chain variable region CDR1 comprising amino acids having the sequence set forth in SEQ ID NO:929 or conservative modifications thereof; (b) a heavy chain variable region CDR2 comprising amino acids having the sequence set forth in SEQ ID NO:930 or conservative modifications thereof; (c) a heavy chain variable region CDR3 comprising amino acids having the sequence set forth in SEQ ID NO:931 or conservative modifications thereof (d) a light chain variable region CDR1 comprising amino acids having the sequence set forth in SEQ ID NO:932 or conservative modifications thereof; (e) a light chain variable region CDR2 comprising amino acids having the sequence set forth in SEQ ID NO:933 or conservative modifications thereof, and (f) a light chain variable region CDR3 comprising amino acids having the sequence set forth in SEQ ID NO:934 or conservative modifications thereof.

In certain embodiments, a presently disclosed anti-FcRL5 antibody or antigen-binding fragment thereof comprises: (a) a heavy chain variable region CDR1 comprising the amino acid sequence of SEQ ID NO:440 or conservative modifications thereof; (b) a heavy chain variable region CDR2 comprising the amino acid sequence of SEQ ID NO:441 or conservative modifications thereof (c) a heavy chain variable region CDR3 comprising the amino acid sequence of SEQ ID NO:442 or conservative modifications thereof (d) a light chain variable region CDR1 comprising the amino acid sequence of SEQ ID NO:329 or conservative modifications thereof; (e) a light chain variable region CDR2 comprising the amino acid sequence of SEQ ID NO:330 or conservative modifications thereof; and (f) a light chain variable region CDR3 comprising the amino acid sequence of SEQ ID NO:443 or conservative modifications thereof.

In certain embodiments, a presently disclosed anti-FcRL5 antibody or antigen-binding fragment thereof comprises: (a) a heavy chain variable region CDR1 comprising the amino acid sequence of SEQ ID NO:309 or conservative modifications thereof; (b) a heavy chain variable region CDR2 comprising the amino acid sequence of SEQ ID NO:310 or conservative modifications thereof; (c) a heavy chain variable region CDR3 comprising the amino acid sequence of SEQ ID NO:489 or conservative modifications thereof; (d) a light chain variable region CDR1 comprising the amino acid sequence of SEQ ID NO:490 or conservative modifications thereof; (e) a light chain variable region CDR2 comprising the amino acid sequence of SEQ ID NO:313 or conservative modifications thereof; and (f) a light chain variable region CDR3 comprising the amino acid sequence of SEQ ID NO:491 or conservative modifications thereof.

As used herein, the terms "conservative sequence modifications" and "conservative modifications" refers to amino acid modifications that do not significantly affect or alter the binding characteristics of the presently disclosed CAR (e.g., the extracellular antigen-binding domain) comprising the amino acid sequence. Such conservative modifications include amino acid substitutions, additions and deletions. Modifications can be introduced into the human scFv of the presently disclosed subject matter by standard techniques known in the art, such as site-directed mutagenesis and PCR-mediated mutagenesis. Amino acids can be classified into groups according to their physicochemical properties such as charge and polarity.

Conservative amino acid substitutions are ones in which the amino acid residue is replaced with an amino acid within the same group. For example, amino acids can be classified by charge: positively-charged amino acids include lysine, arginine, histidine, negatively-charged amino acids include aspartic acid, glutamic acid, neutral charge amino acids include alanine, asparagine, cysteine, glutamine, glycine, isoleucine, leucine, methionine, phenylalanine, proline, serine, threonine, tryptophan, tyrosine, and valine. In addition, amino acids can be classified by polarity: polar amino acids include arginine (basic polar), asparagine, aspartic acid (acidic polar), glutamic acid (acidic polar), glutamine, histidine (basic polar), lysine (basic polar), serine, threonine, and tyrosine; non-polar amino acids include alanine, cysteine, glycine, isoleucine, leucine, methionine, phenylalanine, proline, tryptophan, and valine. Thus, one or more amino acid residues within a CDR region can be replaced with other amino acid residues from the same group and the altered antibody can be tested for retained function (i.e., the functions set forth in (c) through (l) above) using the functional assays described herein. In certain embodiments, no more than one, no more than two, no more than three, no more than four, no more than five residues within a specified sequence or a CDR region are altered. Exemplary conservative amino acid substitutions are shown in Table 231.

TABLE 231

| Original Residue | Exemplary conservative amino acid Substitutions |
|---|---|
| Ala (A) | Val; Leu; Ile |
| Arg (R) | Lys; Gln; Asn |
| Asn (N) | Gln; His; Asp, Lys; Arg |
| Asp (D) | Glu; Asn |
| Cys (C) | Ser; Ala |
| Gln (Q) | Asn; Glu |
| Glu (E) | Asp; Gln |
| Gly (G) | Ala |
| His (H) | Asn; Gln; Lys; Arg |
| Ile (I) | Leu; Val; Met; Ala; Phe |
| Leu (L) | Ile; Val; Met; Ala; Phe |
| Lys (K) | Arg; Gln; Asn |
| Met (M) | Leu; Phe; Ile |
| Phe (F) | Trp; Leu; Val; Ile; Ala; Tyr |
| Pro (P) | Ala |
| Ser (S) | Thr |
| Thr (T) | Val; Ser |
| Trp (W) | Tyr; Phe |
| Tyr (Y) | Trp; Phe; Thr; Ser |
| Val (V) | Ile; Leu; Met; Phe; Ala |

In certain non-limiting embodiments, an extracellular antigen-binding domain of the CAR can comprise a linker connecting the heavy chain variable region and light chain variable region of the extracellular antigen-binding domain. As used herein, the term "linker" refers to a functional group (e.g., chemical or polypeptide) that covalently attaches two or more polypeptides or nucleic acids so that they are connected to one another. As used herein, a "peptide linker" refers to one or more amino acids used to couple two proteins together (e.g., to couple $V_H$ and $V_L$ domains). Non-limiting examples of peptide linkers are disclosed in Shen et al., Anal. Chem. 80(6):1910-1917 (2008).

In one non-limiting example, the linker is a G4S linker that comprises amino acids having the sequence set forth in SEQ ID NO:897. In certain embodiments, the nucleotide sequence encoding the amino acid sequence of SEQ ID NO:897 is set forth in SEQ ID NO:898. In one non-limiting example, the linker comprises amino acids having the sequence set forth in SEQ ID NO:307. In certain embodiments, the nucleotide sequence encoding the amino acid sequence of SEQ ID NO:307 is set forth in SEQ ID NO:305.

In certain embodiments, the linker comprises amino acids having the sequence set forth in SEQ ID NO:901 as provided below.

[SEQ ID NO: 901]
GGGGS.

In certain embodiments, the linker comprises amino acids having the sequence set forth in SEQ ID NO:902 as provided below.

[SEQ ID NO: 902]
SGGSGGS.

In certain embodiments, the linker comprises amino acids having the sequence set forth in SEQ ID NO:903 as provided below.

[SEQ ID NO: 903]
GGGGSGGGS.

In certain embodiments, the linker comprises amino acids having the sequence set forth in SEQ ID NO:904 as provided below.

[SEQ ID NO: 904]
GGGGSGGGGS.

In certain embodiments, the linker comprises amino acids having the sequence set forth in SEQ ID NO:905 as provided below.

[SEQ ID NO: 905]
GGGGSGGGGSGGGGGGS.

In certain embodiments, the linker comprises amino acids having the sequence set forth in SEQ ID NO:906 as provided below.

[SEQ ID NO: 906]
GGGGSGGGGSGGGGSGGGGS.

In certain embodiments, the linker comprises amino acids having the sequence set forth in SEQ ID NO:907 as provided below.

[SEQ ID NO: 907]
GGGGSGGGGSGGGGSGGGGSGGGGS.

In certain embodiments, the linker comprises amino acids having the sequence set forth in SEQ ID NO:908 as provided below.

[SEQ ID NO: 908]
GGGGSGGGGSGGGGSGGGGSGGGGSGGGGS.

In certain embodiments, the linker comprises amino acids having the sequence set forth in SEQ ID NO:909 as provided below.

[SEQ ID NO: 909]
GGGGSGGGGSGGGGSGGGGSGGGGSGGGGSGGGGS.

In certain embodiments, the linker comprises amino acids having the sequence set forth in SEQ ID NO:910 as provided below.

[SEQ ID NO: 910]
EPKSCDKTHTCPPCP.

In certain embodiments, the linker comprises amino acids having the sequence set forth in SEQ ID NO:911 as provided below.

[SEQ ID NO: 911]
GGGGSGGGSEPKSCDKTHTCPPCP.

In certain embodiments, the linker comprises amino acids having the sequence set forth in SEQ ID NO:912 as provided below.

[SEQ ID NO: 912]
ELKTPLGDTTHTCPRCPEPKSCDTPPPCPRCPEPKSCDTPPPCPRCPEPKSCDTPPPCPRCP.

In certain embodiments, the linker comprises amino acids having the sequence set forth in SEQ ID NO:913 as provided below.

[SEQ ID NO: 913]
GSGSGS.

In certain embodiments, the the linker comprises amino acids having the sequence set forth in SEQ ID NO:914 as provided below.

[SEQ ID NO: 914]
AAA.

In certain embodiments, the extracellular antigen-binding domain (e.g., scFv) comprises a heavy chain variable region, a light chain variable region and a linker peptide between the heavy chain variable region and the light chain variable region. Non-limiting examples of extracellular antigen-binding domains, e.g., scFvs, of the present disclosure that comprise a heavy chain variable region, a light chain variable region and a linker peptide are disclosed in Tables 77-152. For example, and not by way of limitation, the extracellular antigen-binding domain comprising a heavy chain variable region, a light chain variable region and a linker peptide of the present disclosure comprises an amino acid sequence selected from the group consisting of SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:644, SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:680, SEQ ID NO:682, SEQ ID NO:684, SEQ ID NO:686, SEQ ID NO:688, SEQ ID NO:690, SEQ ID NO:692, SEQ ID NO:694, SEQ ID NO:696, SEQ ID NO:698, SEQ ID NO:700, SEQ ID NO:702, SEQ ID NO:704, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:722, SEQ ID NO:724, SEQ ID NO:726, SEQ ID NO:728, SEQ ID NO:730, SEQ ID NO:732, SEQ ID NO:734, SEQ ID NO:736, SEQ ID NO:738, SEQ ID NO:740, SEQ ID NO:742, SEQ ID NO:744 and conservative modifications of (as shown in Tables 77-152).

In certain embodiments, the extracellular antigen-binding domain (e.g., scFv) having a heavy chain variable region, a light chain variable region and a linker peptide comprises the amino acid sequence of SEQ ID NO:650 or conservative modifications of.

In certain embodiments, the extracellular antigen-binding domain (e.g., scFv) having a heavy chain variable region, a light chain variable region and a linker peptide comprises the amino acid sequence of SEQ ID NO:664 or conservative modifications of.

In certain embodiments, the extracellular antigen-binding domain (e.g., scFv) having a heavy chain variable region, a light chain variable region and a linker peptide comprises the amino acid sequence of SEQ ID NO:678 or conservative modifications of.

In certain embodiments, the extracellular antigen-binding domain (e.g., scFv) having a heavy chain variable region, a light chain variable region and a linker peptide comprises the amino acid sequence of SEQ ID NO:700 or conservative modifications of.

In certain embodiments, the extracellular antigen-binding domain (e.g., scFv) having a heavy chain variable region, a light chain variable region and a linker peptide comprises the amino acid sequence of SEQ ID NO:702 or conservative modifications of.

In certain embodiments, the extracellular antigen-binding domain (e.g., scFv) having a heavy chain variable region, a light chain variable region and a linker peptide comprises the amino acid sequence of SEQ ID NO:710 or conservative modifications of.

In certain embodiments, the extracellular antigen-binding domain (e.g., scFv) having a heavy chain variable region, a light chain variable region and a linker peptide comprises the amino acid sequence of SEQ ID NO:726 or conservative modifications of.

In certain embodiments, the extracellular antigen-binding domain (e.g., scFv) having a heavy chain variable region, a light chain variable region and a linker peptide comprises the amino acid sequence of SEQ ID NO:650 or conservative modifications of.

In certain embodiments, the extracellular antigen-binding domain (e.g., scFv) having a heavy chain variable region, a light chain variable region and a linker peptide comprises the amino acid sequence of SEQ ID NO:678 or conservative modifications of.

In addition, the extracellular antigen-binding domain can comprise a leader or a signal peptide that directs the nascent protein into the endoplasmic reticulum. Signal peptide or leader can be essential if the CAR is to be glycosylated and anchored in the cell membrane. The signal sequence or leader can be a peptide sequence (about 5, about 10, about 15, about 20, about 25, or about 30 amino acids long) present at the N-terminus of newly synthesized proteins that directs their entry to the secretory pathway. In non-limiting examples, the signal peptide is covalently joined to the 5' terminus of the extracellular antigen-binding domain. In certain embodiments, the signal peptide comprises a CD8 polypeptide comprising amino acids having the sequence set forth in SEQ ID NO:26 as provided below.

[SEQ ID NO: 935]
MALPVTALLLPLALLLHAAR

The nucleotide sequence encoding the amino acid sequence of SEQ ID NO:935 is set forth in SEQ ID NO:936, which is provided below:

[SEQ ID NO: 936]
ATGGCTCTCCCAGTGACTGCCCTACTGCTTCCCCTAGCGCTTCTCCTGCA

TGCAGCTCGT

In another embodiment, the signal peptide comprises amino acids having the sequence set forth in SEQ ID NO:937 as provided below.

[SEQ ID NO: 937]
METDTLLLWVLLLWVPGSTG

The nucleotide sequence encoding the amino acid sequence of SEQ ID NO:937 is set forth in SEQ ID NO:938, which is provided below:

[SEQ ID NO: 938]
ATGGAAACCGACACCCTGCTGCTGTGGGTGCTGCTGCTGTGGGTGCCAGG

ATCCACAGGA

In certain embodiments, the extracellular antigen-binding domain, e.g., the human scFv, comprises a heavy chain variable region, a light chain variable region, a linker peptide between the heavy chain variable region and the light chain variable region, and an His-tag and an HA-tag. In certain embodiments, the amino acid sequence of the His-tag and HA-tag comprises the amino acid sequence of SEQ ID NO:308. The nucleotide sequence encoding SEQ ID NO: 308 is SEQ ID NO: 306.

In certain embodiments, the extracellular antigen-binding domain, e.g., the human scFv, binds to a human FcRL5 polypeptide comprising the amino acid sequence set forth in SEQ ID NO: 899. In certain embodiments, the extracellular antigen-binding domain, e.g., the human scFv, binds to an epitope in domain 9 (e.g., amino acids 754-835 of SEQ ID NO:899). In certain embodiments, the extracellular antigen-binding domain, e.g., the human scFv, binds to an epitope in domain 8 (e.g., amino acids 658-731 of SEQ ID NO:899). In certain embodiments, the extracellular antigen-binding domain, e.g., the human scFv, binds to an epitope within domain 9 comprising amino acids 829-840 of SEQ ID NO:899. In certain embodiments, the extracellular antigen-binding domain, e.g., the human scFv, binds to an epitope within domain 8 comprising amino acids 657-667 of SEQ ID NO:899. For example, and not by way of limitation, the extracellular antigen-binding domain, e.g., the human scFv, binds to an epitope comprising the amino acid sequence RSETVTLYITGL (SEQ ID NO:964). In certain embodiments, an antibody or an antigen-binding fragment thereof of the present disclosure binds to an epitope comprising the amino acid sequence SRPILTFRAPR (SEQ ID NO:965).

Transmembrane Domain of a CAR

In certain non-limiting embodiments, the transmembrane domain of the CAR comprises a hydrophobic alpha helix that spans at least a portion of the membrane. Different transmembrane domains result in different receptor stability. After antigen recognition, receptors cluster and a signal is transmitted to the cell. In accordance with the presently disclosed subject matter, the transmembrane domain of the CAR can comprise a CD8 polypeptide, a CD28 polypeptide, a CD3ζ polypeptide, a CD4 polypeptide, a 4-1BB polypeptide, an OX40 polypeptide, an ICOS polypeptide, a CTLA-4 polypeptide, a PD-1 polypeptide, a LAG-3 polypeptide, a 2B4 polypeptide, a BTLA polypeptide, a synthetic peptide (not based on a protein associated with the immune response), or a combination thereof.

In certain embodiments, the transmembrane domain of a presently disclosed CAR comprises a CD28 polypeptide. The CD28 polypeptide can have an amino acid sequence that is at least about 85%, about 90%, about 95%, about 96%, about 97%, about 98%, about 99% or 100% homologous to the sequence having a NCBI Reference No: P10747 or NP_006130 (SEQ ID NO:939), or fragments thereof, and/or may optionally comprise up to one or up to two or up to three conservative amino acid substitutions. In non-limiting embodiments, the CD28 polypeptide can have an amino acid sequence that is a consecutive portion of SEQ ID NO:939 which is at least 20, or at least 30, or at least 40, or at least 50, and up to 220 amino acids in length. Alternatively or additionally, in non-limiting various embodiments, the CD28 polypeptide has an amino acid sequence of amino acids 1 to 220, 1 to 50, 50 to 100, 100 to 150, 150 to 200, or 200 to 220 of SEQ ID NO:939. In certain embodiments, the CAR of the presently disclosed subject matter comprises a transmembrane domain comprising a CD28 polypeptide, and an intracellular domain comprising a co-stimulatory signaling region that comprises a CD28 polypeptide. In certain embodiments, the CD28 polypeptide comprised in the transmembrane domain and the intracellular domain has an amino acid sequence of amino acids 114 to 220 of SEQ ID NO:939.

SEQ ID NO:939 is provided below:

[SEQ ID NO: 939]
```
1   MLRLLLALNL FPSIQVTGNK ILVKQSPMLV AYDNAVNLSC KYSYNLFSRE FRASLHKGLD

61  SAVEVCVVYG NYSQQLQVYS KTGFNCDGKL GNESVTFYLQ NLYVNQTDIY FCKIEVMYPP

121 PYLDNEKSNG TIIHVKGKHL CPSPLFPGPS KPFWVLVVVG GVLACYSLLV TVAFIIFWVR

181 SKRSRLLHSD YMNMTPRRPG PTRKHYQPYA PPRDFAAYRS
```

In accordance with the presently disclosed subject matter, a "CD28 nucleic acid molecule" refers to a polynucleotide encoding a CD28 polypeptide. In certain embodiments, the CD28 nucleic acid molecule encoding the CD28 polypeptide comprised in the transmembrane domain and the intracellular domain (e.g., the co-stimulatory signaling region) of the presently disclosed CAR (amino acids 114 to 220 of SEQ ID NO:939) comprises nucleic acids having the sequence set forth in SEQ ID NO:940 as provided below.

[SEQ ID NO: 940]
```
ATTGAAGTTATGTATCCTCCTCCTTACCTAGACAATGAGAAGAGCAATGG

AACCATTATCCATGTGAAAGGGAAACACCTTTGTCCAAGTCCCCTATTTC

CCGGACCTTCTAAGCCCTTTTGGGTGCTGGTGGTGGTTGGTGGAGTCCTG

GCTTGCTATAGCTTGCTAGTAACAGTGGCCTTTATTATTTTCTGGGTGAG

GAGTAAGAGGAGCAGGCTCCTGCACAGTGACTACATGAACATGACTCCCC

GCCGCCCCGGGCCCACCCGCAAGCATTACCAGCCCTATGCCCCACCACGC

GACTTCGCAGCCTATCGCTCC.
```

In certain embodiments, the transmembrane domain of a presently disclosed CAR comprises a CD8 polypeptide. The CD8 polypeptide can have an amino acid sequence that is at least about 85%, about 90%, about 95%, about 96%, about 97%, about 98%, about 99% or 100% homologous to the sequence having a NCBI Reference No: AAH25715 (SEQ ID NO:960), or fragments thereof, and/or may optionally comprise up to one or up to two or up to three conservative amino acid substitutions. In non-limiting embodiments, the CD8 polypeptide can have an amino acid sequence that is a consecutive portion of SEQ ID NO:960 which is at least 20, or at least 30, or at least 40, or at least 50, or at least 70, or at least 100, or at least 150, or at least 200 and up to 235 amino acids in length. Alternatively or additionally, in non-limiting various embodiments, the CD8 polypeptide has an amino acid sequence of amino acids 1 to 235, 1 to 50, 50 to 100, 100 to 150, 150 to 200, 130 to 210, or 200 to 235 of SEQ ID NO:960. In certain embodiments, the CAR of the presently disclosed subject matter comprises a transmembrane domain comprising a CD8 polypeptide. In certain embodiments, the CD8 polypeptide comprised in the transmembrane domain has an amino acid sequence of amino acids 137 to 207 of SEQ ID NO:960.

SEQ ID NO:960 is provided below:

[SEQ ID NO: 960]
```
1   malpvtalll plalllhaar psqfrvspld rtwnlgetve lkcqvllsnp tsgcswlfqp 61  rgaaasptfl lylsqnkpka aegldtqrfs gkrlgdtfvl tlsdfrrene gcyfcsalsn 121 simyfshfvp vflpakpttt paprpptpap tiasqplslr peacrpaagg avhtrgldfa 181 cdiyiwapla gtcgvlllsl vitlycnhrn rrrvckcprp vvksgdkpsl saryv
```

In accordance with the presently disclosed subject matter, a "CD8 nucleic acid molecule" refers to a polynucleotide encoding a CD8 polypeptide. In certain embodiments, the CD8 nucleic acid molecule encoding the CD8 polypeptide comprised in the transmembrane domain and the intracellular domain (e.g., the co-stimulatory signaling region) of the presently disclosed CAR (amino acids 137 to 207 of SEQ ID NO:960) comprises nucleic acids having the sequence set forth in SEQ ID NO:961 as provided below.

[SEQ ID NO: 961]
CCCACCACGACGCCAGCGCCGCGACCACCAACCCCGGCGCCCACGATCGC

GTCGCAGCCCCTGTCCCTGCGCCCAGAGGCGTGCCGGCCAGCGGCGGGGG

GCGCAGTGCACACGAGGGGGCTGGACTTCGCCTGTGATATCTACATCTGG

GCGCCCCTGGCCGGGACTTGTGGGGTCCTTCTCCTGTCACTGGTTATCAC

CCTTTACTGCAAC

In certain non-limiting embodiments, a CAR can also comprise a spacer region that links the extracellular antigen-binding domain to the transmembrane domain. The spacer region can be flexible enough to allow the antigen binding domain to orient in different directions to facilitate antigen recognition. The spacer region can be the hinge region from IgG1, or the CH$_2$CH$_3$ region of immunoglobulin and portions of CD3.

Intracellular Domain of a CAR

In certain non-limiting embodiments, an intracellular domain of the CAR can comprise a CD3ζ polypeptide, which can activate or stimulate a cell (e.g., a cell of the lymphoid lineage, e.g., a T cell). CD3ζ comprises three ITAMs, and transmits an activation signal to the cell (e.g., a cell of the lymphoid lineage, e.g., a T cell) after antigen is bound. The CD3ζ polypeptide can have an amino acid sequence that is at least about 85%, about 90%, about 95%, about 96%, about 97%, about 98%, about 99% or about 100% homologous to the sequence set forth in SEQ ID NO:941, or fragments thereof, and/or may optionally comprise up to one or up to two or up to three conservative amino acid substitutions. In non-limiting embodiments, the CD3ζ polypeptide can have an amino acid sequence that is a consecutive portion of SEQ ID NO:941 which is at least 20, or at least 30, or at least 40, or at least 50, and up to 163 amino acids in length. Alternatively or additionally, in non-limiting various embodiments, the CD3ζ polypeptide has an amino acid sequence of amino acids 1 to 163, 1 to 50, 50 to 100, 100 to 150, or 150 to 163 of SEQ ID NO:941. In certain embodiments, the CD3ζ polypeptide comprised in the intracellular domain of a presently disclosed CAR has an amino acid sequence of amino acids 52 to 163 of SEQ ID NO: 941.

SEQ ID NO: 941 is provided below:

closed CARs (amino acids 52 to 163 of SEQ ID NO: 941) comprises nucleic acids having the sequence set forth in SEQ ID NO:942 as provided below.

[SEQ ID NO: 942]
AGAGTGAAGTTCAGCAGGAGCGCAGACGCCCCCGCGTACCAGCAGGGCCA

GAACCAGCTCTATAACGAGCTCAATCTAGGACGAAGAGAGGAGTACGATG

TTTTGGACAAGAGACGTGGCCGGGACCCTGAGATGGGGGGAAAGCCGAGA

AGGAAGAACCCTCAGGAAGGCCTGTACAATGAACTGCAGAAAGATAAGAT

GGCGGAGGCCTACAGTGAGATTGGGATGAAAGGCGAGCGCCGGAGGGGCA

AGGGGCACGATGGCCTTTACCAGGGTCTCAGTACAGCCACCAAGGACACC

TACGACGCCCTTCACATGCAGGCCCTGCCCCCTCGCTAA

In certain non-limiting embodiments, an intracellular domain of the CAR further comprises at least one signaling region. The at least one signaling region can include a CD28 polypeptide, a 4-1BB polypeptide, an OX40 polypeptide, an ICOS polypeptide, a DAP-10 polypeptide, a PD-1 polypeptide, a CTLA-4 polypeptide, a LAG-3 polypeptide, a 2B4 polypeptide, a BTLA polypeptide, a synthetic peptide (not based on a protein associated with the immune response), or a combination thereof.

In certain embodiments, the signaling region is a co-stimulatory signaling region. In certain embodiments, the co-stimulatory region comprises at least one co-stimulatory molecule, which can provide optimal lymphocyte activation. As used herein, "co-stimulatory molecules" refer to cell surface molecules other than antigen receptors or their ligands that are required for an efficient response of lymphocytes to antigen. The at least one co-stimulatory signaling region can include a CD28 polypeptide, a 4-1BB polypeptide, an OX40 polypeptide, an ICOS polypeptide, a DAP-10 polypeptide, or a combination thereof. The co-stimulatory molecule can bind to a co-stimulatory ligand, which is a protein expressed on cell surface that upon binding to its receptor produces a co-stimulatory response, i.e., an intracellular response that effects the stimulation provided when an antigen binds to its CAR molecule. Co-stimulatory ligands, include, but are not limited to CD80, CD86, CD70, OX40L, 4-1BBL, CD48, TNFRSF14, and PD-L1. As one example, a 4-1BB ligand (i.e., 4-1BBL) may bind to 4-1BB (also known as "CD137") for providing an intracellular signal that in combination with a CAR signal induces an effector cell function of the CAR$^+$ T cell. CARs comprising an intracellular domain that comprises a co-stimulatory signaling region comprising 4-1BB, ICOS or DAP-10 are disclosed in U.S. Pat. No. 7,446,190 (e.g., the nucleotide sequence encoding 4-1BB is set forth in SEQ ID NO:15, the nucleotide sequence encoding ICOS is set forth

[SEQ ID NO: 941]
1 MKWKALFTAA ILQAQLPITE AQSFGLLDPK LCYLLDGILF IYGVILTALF LRVKFSRSAD

61 APAYQQGQNQ LYNELNLGRR EEYDVLDKRR GRDPEMGGKP RRKNPQEGLY NELQKDKMAE

121 AYSEIGMKGE RRRGKGHDGL YQGLSTATKD TYDALHMQAL PPR

In accordance with the presently disclosed subject matter, a "CD3ζ nucleic acid molecule" refers to a polynucleotide encoding a CD3ζ polypeptide. In certain embodiments, the CD3ζ nucleic acid molecule encoding the CD3ζ polypeptide comprised in the intracellular domain of a presently disin SEQ ID NO:16, and the nucleotide sequence encoding DAP-10 is set forth in SEQ ID NO:17 in U.S. Pat. No. 7,446,190), which is herein incorporated by reference in its entirety. In certain embodiments, the intracellular domain of the CAR comprises a co-stimulatory signaling region that comprises a CD28 polypeptide. In certain embodiments, the intracellular domain of the CAR comprises a co-stimulatory signaling region that comprises two co-stimulatory molecules: CD28 and 4-1BB or CD28 and OX40.

4-1BB can act as a tumor necrosis factor (TNF) ligand and have stimulatory activity. The 4-1BB polypeptide can have an amino acid sequence that is at least about 85%, about 90%, about 95%, about 96%, about 97%, about 98%, about 99% or 100% homologous to the sequence having a NCBI Reference No: P41273 or NP_001552 (SEQ ID NO:943) or fragments thereof, and/or may optionally comprise up to one or up to two or up to three conservative amino acid substitutions. In certain embodiments, the 4-1BB polypeptide comprised in the intracellular domain of a presently disclosed CAR has an amino acid sequence of amino acids 214 to 255 of SEQ ID NO: 943. SEQ ID NO:943 is provided below:

```
                                                      [SEQ ID NO: 943]
  1 MGNSCYNIVA TLLLVLNFER TRSLQDPCSN CPAGTFCDNN RNQICSPCPP NSFSSAGGQR

61 TCDICRQCKG VFRTRKECSS TSNAECDCTP GFHCLGAGCS MCEQDCKQGQ ELTKKGCKDC

121 CFGTFNDQKR GICRPWTNCS LDGKSVLVNG TKERDVVCGP SPADLSPGAS SVTPPAPARE

181 PGHSPQIISF FLALTSTALL FLLFFLTLRF SVVKRGRKKL LYIFKQPFMR PVQTTQEEDG

241 CSCRFPEEEE GGCEL
```

In accordance with the presently disclosed subject matter, a "4-1BB nucleic acid molecule" refers to a polynucleotide encoding a 4-1BB polypeptide. In certain embodiments, the 4-1BB nucleic acid molecule encoding the 4-1BB polypeptide comprised in the intracellular domain of a presently disclosed CARs (amino acids 214 to 255 of SEQ ID NO: 943) comprises nucleic acids having the sequence set forth in SEQ ID NO: 962 as provided below.

```
                                            [SEQ ID NO: 962]
AAACGGGGCAGAAAGAAGCTCCTGTATATATTCAAACAACCATTTATGAG

ACCAGTACAAACTACTCAAGAGGAAGATGGCTGTAGCTGCCGATTTCCAG

AAGAAGAAGAAGGAGGATGTGAACTG
```

An OX40 polypeptide can have an amino acid sequence that is at least about 85%, about 90%, about 95%, about 96%, about 97%, about 98%, about 99% or 100% homologous to the sequence having a NCBI Reference No: P43489 or NP_003318 (SEQ ID NO:944), or fragments thereof, and/or may optionally comprise up to one or up to two or up to three conservative amino acid substitutions.

SEQ ID NO:944 is provided below:

```
                                                      [SEQ ID NO: 944]
  1 MCVGARRLGR GPCAALLLLG LGLSTVTGLH CVGDTYPSND RCCHECRPGN GMVSRCSRSQ

61 NTVCRPCGPG FYNDVVSSKP CKPCTWCNLR SGSERKQLCT ATQDTVCRCR AGTQPLDSYK

121 PGVDCAPCPP GHFSPGDNQA CKPWTNCTLA GKHTLQPASN SSDAICEDRD PPATQPQETQ

181 GPPARPITVQ PTEAWPRTSQ GPSTRPVEVP GGRAVAAILG LGLVLGLLGP LAILLALYLL

241 RRDQRLPPDA HKPPGGGSFR TPIQEEQADA HSTLAKI
```

In accordance with the presently disclosed subject matter, an "OX40 nucleic acid molecule" refers to a polynucleotide encoding an OX40 polypeptide.

An ICOS polypeptide can have an amino acid sequence that is at least about 85%, about 90%, about 95%, about 96%, about 97%, about 98%, about 99% or 100% homologous to the sequence having a NCBI Reference No: NP_036224 (SEQ ID NO:945) or fragments thereof, and/or may optionally comprise up to one or up to two or up to three conservative amino acid substitutions.

SEQ ID NO:945 is provided below:

[SEQ ID NO: 945]
```
  1 MKSGLWYFFL FCLRIKVLTG EINGSANYEM FIFHNGGVQI LCKYPDIVQQ FKMQLLKGGQ

61 ILCDLTKTKG SGNTVSIKSL KFCHSQLSNN SVSFFLYNLD HSHANYYFCN LSIFDPPPFK

121 VTLTGGYLHI YESQLCCQLK FWLPIGCAAF VVVCILGCIL ICWLTKKKYS SSVHDPNGEY

181 MFMRAVNTAK KSRLTDVTL
```

In accordance with the presently disclosed subject matter, an "ICOS nucleic acid molecule" refers to a polynucleotide encoding an ICOS polypeptide.

CTLA-4 is an inhibitory receptor expressed by activated T cells, which when engaged by its corresponding ligands (CD80 and CD86; B7-1 and B7-2, respectively), mediates activated T cell inhibition or anergy. In both preclinical and clinical studies, CTLA-4 blockade by systemic antibody infusion, enhanced the endogenous anti-tumor response albeit, in the clinical setting, with significant unforeseen toxicities.

CTLA-4 contains an extracellular V domain, a transmembrane domain, and a cytoplasmic tail. Alternate splice variants, encoding different isoforms, have been characterized. The membrane-bound isoform functions as a homodimer interconnected by a disulfide bond, while the soluble isoform functions as a monomer. The intracellular domain is similar to that of CD28, in that it has no intrinsic catalytic activity and contains one YVKM motif able to bind PI3K, PP2A and SHP-2 and one proline-rich motif able to bind SH3 containing proteins. One role of CTLA-4 in inhibiting T cell responses seem to be directly via SHP-2 and PP2A dephosphorylation of TCR-proximal signaling proteins such as CD3 and LAT. CTLA-4 can also affect signaling indirectly via competing with CD28 for CD80/86 binding. CTLA-4 has also been shown to bind and/or interact with PI3K, CD80, AP2M1, and PPP2R5A.

In accordance with the presently disclosed subject matter, a CTLA-4 polypeptide can have an amino acid sequence that is at least about 85%, about 90%, about 95%, about 96%, about 97%, about 98%, about 99% or about 100% homologous to UniProtKB/Swiss-Prot Ref. No.: P16410.3 (SEQ ID NO:946) (homology herein may be determined using standard software such as BLAST or FASTA) or fragments thereof, and/or may optionally comprise up to one or up to two or up to three conservative amino acid substitutions.

SEQ ID NO:946 is provided below:

[SEQ ID NO: 946]
```
  1 MACLGFQRHK AQLNLATRTW PCTLLFFLLF IPVFCKAMHV AQPAVVLASS RGIASFVCEY

61 ASPGKATEVR VTVLRQADSQ VTEVCAATYM MGNELTFLDD SICTGTSSGN QVNLTIQGLR

121 AMDTGLYICK VELMYPPPYY LGIGNGTQIY VIDPEPCPDS DFLLWILAAV SSGLFFYSFL

181 LTAVSLSKML KKRSPLTTGV YVKMPPTEPE CEKQFQPYFI PIN
```

In accordance with the presently disclosed subject matter, a "CTLA-4 nucleic acid molecule" refers to a polynucleotide encoding a CTLA-4 polypeptide.

PD-1 is a negative immune regulator of activated T cells upon engagement with its corresponding ligands PD-L1 and PD-L2 expressed on endogenous macrophages and dendritic cells. PD-1 is a type I membrane protein of 268 amino acids. PD-1 has two ligands, PD-L1 and PD-L2, which are members of the B7 family. The protein's structure comprises an extracellular IgV domain followed by a transmembrane region and an intracellular tail. The intracellular tail contains two phosphorylation sites located in an immunoreceptor tyrosine-based inhibitory motif and an immunoreceptor tyrosine-based switch motif, that PD-1 negatively regulates TCR signals. SHP-I and SHP-2 phosphatases bind to the cytoplasmic tail of PD-1 upon ligand binding. Upregulation of PD-L1 is one mechanism tumor cells may evade the host immune system. In pre-clinical and clinical trials, PD-1 blockade by antagonistic antibodies induced anti-tumor responses mediated through the host endogenous immune system.

In accordance with the presently disclosed subject matter, a PD-1 polypeptide can have an amino acid sequence that is at least about 85%, about 90%, about 95%, about 96%, about 97%, about 98%, about 99% or about 100% homologous to NCBI Reference No: NP_005009.2 (SEQ ID NO:947) or fragments thereof, and/or may optionally comprise up to one or up to two or up to three conservative amino acid substitutions. SEQ ID NO:947 is provided below:

[SEQ ID NO: 947]

```
  1 MQIPQAPWPV VWAVLQLGWR PGWFLDSPDR PWNPPTFSPA LLVVTEGDNA TFTCSFSNTS

61 ESFVLNWYRM SPSNQTDKLA AFPEDRSQPG QDCRFRVTQL PNGRDFHMSV VRARRNDSGT

121 YLCGAISLAP KAQIKESLRA ELRVTERRAE VPTAHPSPSP RPAGQFQTLV VGVVGGLLGS

181 LVLLVWVLAV ICSRAARGTI GARRTGQPLK EDPSAVPVFS VDYGELDFQW REKTPEPPVP

241 CVPEQTEYAT IVFPSGMGTS SPARRGSADG PRSAQPLRPE DGHCSWPL
```

In accordance with the presently disclosed subject matter, a "PD-1 nucleic acid molecule" refers to a polynucleotide encoding a PD-1 polypeptide.

Lymphocyte-activation protein 3 (LAG-3) is a negative immune regulator of immune cells. LAG-3 belongs to the immunoglobulin (lg) superfamily and contains 4 extracellular Ig-like domains. The LAG3 gene contains 8 exons. The sequence data, exon/intron organization, and chromosomal localization all indicate a close relationship of LAG3 to CD4. LAG3 has also been designated CD223 (cluster of differentiation 223).

In accordance with the presently disclosed subject matter, a LAG-3 polypeptide can have an amino acid sequence that is at least about 85%, about 90%, about 95%, about 96%, about 97%, about 98%, about 99% or about 100% homologous to UniProtKB/Swiss-Prot Ref. No.: P18627.5 (SEQ ID NO:948) or fragments thereof, and/or may optionally comprise up to one or up to two or up to three conservative amino acid substitutions.

SEQ ID NO:948 is provided below:

[SEQ ID NO: 948]

```
  1 MWEAQFLGLL FLQPLWVAPV KPLQPGAEVP VVWAQEGAPA QLPCSPTIPL QDLSLLRRAG

61 VTWQHQPDSG PPAAAPGHPL APGPHPAAPS SWGPRPRRYT VLSVGPGGLR SGRLPLQPRV

121 QLDERGRQRG DFSLWLRPAR RADAGEYRAA VHLRDRALSC RLRLRLGQAS MTASPPGSLR

181 ASDWVILNCS FSRPDRPASV HWFRNRGQGR VPVRESPHHH LAESFLFLPQ VSPMDSGPWG

241 CILTYRDGFN VSIMYNLTVL GLEPPTPLTV YAGAGSRVGL PCRLPAGVGT RSFLTAKWTP

301 PGGGPDLLVT GDNGDFTLRL EDVSQAQAGT YTCHIHLQEQ QLNATVTLAI ITVTPKSFGS

361 PGSLGKLLCE VTPVSGQERF VWSSLDTPSQ RSFSGPWLEA QEAQLLSQPW QCQLYQGERL

421 LGAAVYFTEL SSPGAQRSGR APGALPAGHL LLFLILGVLS LLLLVTGAFG FHLWRRQWRP

481 RRFSALEQGI HPPQAQSKIE ELEQEPEPEP EPEPEPEPEP EPEQL
```

In accordance with the presently disclosed subject matter, a "LAG-3 nucleic acid molecule" refers to a polynucleotide encoding a LAG-3 polypeptide.

Natural Killer Cell Receptor 2B4 (2B4) mediates non-MHC restricted cell killing on NK cells and subsets of T cells. To date, the function of 2B4 is still under investigation, with the 2B4-S isoform believed to be an activating receptor, and the 2B4-L isoform believed to be a negative immune regulator of immune cells. 2B4 becomes engaged upon binding its high-affinity ligand, CD48. 2B4 contains a tyrosine-based switch motif, a molecular switch that allows the protein to associate with various phosphatases. 2B4 has also been designated CD244 (cluster of differentiation 244).

In accordance with the presently disclosed subject matter, a 2B4 polypeptide can have an amino acid sequence that is at least about 85%, about 90%, about 95%, about 96%, about 97%, about 98%, about 99% or about 100% homologous to UniProtKB/Swiss-Prot Ref. No.: Q9BZW8.2 (SEQ ID NO:949) or fragments thereof, and/or may optionally comprise up to one or up to two or up to three conservative amino acid substitutions.

SEQ ID NO:949 is provided below:

```
                                                              [SEQ ID NO: 949]
  1 MLGQVVTLIL LLLLKVYQGK GCQGSADHVV SISGVPLQLQ PNSIQTKVDS IAWKKLLPSQ

61 NGFHHILKWE NGSLPSNTSN DRFSFIVKNL SLLIKAAQQQ DSGLYCLEVT SISGKVQTAT

121 FQVFVFESLL PDKVEKPRLQ GQGKILDRGR CQVALSCLVS RDGNVSYAWY RGSKLIQTAG

181 NLTYLDEEVD INGTHTYTCN VSNPVSWESH TLNLTQDCQN AHQEFRFWPF LVIIVILSAL

241 FLGTLACFCV WRRKRKEKQS ETSPKEFLTI YEDVKDLKTR RNHEQEQTFP GGGSTIYSMI

301 QSQSSAPTSQ EPAYTLYSLI QPSRKSGSRK RNHSPSFNST IYEVIGKSQP KAQNPARLSR

361 KELENFDVYS
```

In accordance with the presently disclosed subject matter, a "2B4 nucleic acid molecule" refers to a polynucleotide encoding a 2B4 polypeptide.

B- and T-lymphocyte attenuator (BTLA) expression is induced during activation of T cells, and BTLA remains expressed on Th1 cells but not Th2 cells. Like PD1 and CTLA4, BTLA interacts with a B7 homolog, B7H4. However, unlike PD-1 and CTLA-4, BTLA displays T-Cell inhibition via interaction with tumor necrosis family receptors (TNF-R), not just the B7 family of cell surface receptors. BTLA is a ligand for tumor necrosis factor (receptor) superfamily, member 14 (TNFRSF14), also known as herpes virus entry mediator (HVEM). BTLA-HVEM complexes negatively regulate T-cell immune responses. BTLA activation has been shown to inhibit the function of human CD8+ cancer-specific T cells. BTLA has also been designated as CD272 (cluster of differentiation 272).

In accordance with the presently disclosed subject matter, a BTLA polypeptide can have an amino acid sequence that is at least about 85%, about 90%, about 95%, about 96%, about 97%, about 98%, about 99% or about 100% homologous to UniProtKB/Swiss-Prot Ref. No.: Q7Z6A9.3 (SEQ ID NO:950) or fragments thereof, and/or may optionally comprise up to one or up to two or up to three conservative amino acid substitutions.

SEQ ID NO:950 is provided below:

```
                                                              [SEQ ID NO: 950]
  1 MKTLPAMLGT GKLFWVFFLI PYLDIWNIHG KESCDVQLYI KRQSEHSILA GDPFELECPV

61 KYCANRPHVT WCKLNGTTCV KLEDRQTSWK EEKNISFFIL HFEPVLPNDN GSYRCSANFQ

121 SNLIESHSTT LYVTDVKSAS ERPSKDEMAS RPWLLYRLLP LGGLPLLITT CFCLFCCLRR

181 HQGKQNELSD TAGREINLVD AHLKSEQTEA STRQNSQVLL SETGIYDNDP DLCFRMQEGS

241 EVYSNPCLEE NKPGIVYASL NHSVIGPNSR LARNVKEAPT EYASICVRS
```

In accordance with the presently disclosed subject matter, a "BTLA nucleic acid molecule" refers to a polynucleotide encoding a BTLA polypeptide.

In certain embodiments, the CAR comprises an extracellular antigen-binding region that specifically binds to human FcRL5, a transmembrane domain comprising a CD28 polypeptide, and an intracellular domain comprising a CD3ζ polypeptide and a co-stimulatory signaling region that comprises a CD28 polypeptide, as shown in FIG. 9. As shown in FIG. 9, the CAR also comprises a signal peptide or a leader covalently joined to the 5' terminus of the extracellular antigen-binding domain. The signal peptide comprises a CD8 polypeptide.

In certain embodiments, the CAR of the presently disclosed subject matter can further comprise an inducible promoter, for expressing nucleic acid sequences in human cells. Promoters for use in expressing CAR genes can be a constitutive promoter, such as ubiquitin C (UbiC) promoter.

The presently disclosed subject matter also provides isolated nucleic acid molecule encoding the FcRL5-targeted CAR described herein or a functional portion thereof. In certain embodiments, the isolated nucleic acid molecule encodes a presently disclosed FcRL5-targeted CAR comprising an scFv that specifically binds to human FcRL5, a transmembrane domain comprising a CD28 polypeptide, and an intracellular domain comprising a CD3ζ polypeptide and a co-stimulatory signaling region comprising a CD28 polypeptide. In certain embodiments, the scFv is a fully human scFv. In certain embodiments, the scFv is a murine scFv. In certain non-limiting embodiments, the isolated nucleic acid molecule comprises nucleic acids having the sequence set forth in SEQ ID NO:951 provided below:

[SEQ ID NO: 951]
ATGGCTCTCCCAGTGACTGCCCTACTGCTTCCCCTAGCGCTTCTCCTGCA

TGCAGCTCGTGTGAAGCTGCAGGAGTCTGGGGGAGGCTTAGTGCAGCCTG

GAGGGTCCCGGAAACTCTCCTGTGCAGCCTCTGGATTCACTTTCAGTATC

TTTGGATTGCACTGGGTTCGTCAGGCTCCAGAGAAGGGGCTGGAGTGGGT

CGCATACATTAGTGGTGACAGTAATACCATCTACTATGCAGACACAGTGA

AGGGCCGATTCACCATCTCCAGAGACAATCCCAAGAACACCCTGTTCCTG

CAAATGACCAGTCTAAGGTCTGAGGACACGGCCATGTATTACTGTGCAAG

AAATAGCTACTATGCTCTGGACTACTGGGGCCAAGGGACCACGGTCACCG

TCTCCTCAGGTGGAGGTGGATCAGGTGGAGGTGGATCTGGTGGAGGTGGA

TCTGACATTGAGCTCACCCAGTCTCCAGCAATCATGTCTGTATCTCCAGG

TGAAAAGGTCACCATGACCTGCAGGGCCAGCTCAAGTGTCAGTTCCAGTT

ACTTGCACTGGTACCAGCAGAGGTCAGGTGCCTCCCCCAAAATCTGGATT

TATAGCACATCCAACTTGGCTTCTGGAGTCCCTGCTCGCTTCAGTGGCAG

TGGGACTGGGACCTCTTACTCTCTCACAATCAGCAGTGTGGAGGCTGAAG

ATGCTGCCACTTATTACTGCCAGCAGTACAGTGGTTACCCGTGGACGTTC

GGTGGAGGGACCAAGCTGGAGATCGAACAAAAACTCATCTCAGAAGAGGA

TCTGGCGGCCGCAATTGAAGTTATGTATCCTCCTCCTTACCTAGACAATG

AGAAGAGCAATGGAACCATTATCCATGTGAAAGGGAAACACCTTTGTCCA

AGTCCCCTATTTCCCGGACCTTCTAAGCCCTTTTGGGTGCTGGTGGTGGT

TGGTGGAGTCCTGGCTTGCTATAGCTTGCTAGTAACAGTGGCCTTTATTA

TTTTCTGGGTGAGGAGTAAGAGGAGCAGGCTCCTGCACAGTGACTACATG

AACATGACTCCCCGCCGCCCCGGGCCCACCCGCAAGCATTACCAGCCCTA

TGCCCCACCACGCGACTTCGCAGCCTATCGCTCCAGAGTGAAGTTCAGCA

GGAGCGCAGACGCCCCCGCGTACCAGCAGGGCCAGAACCAGCTCTATAAC

GAGCTCAATCTAGGACGAAGAGAGGAGTACGATGTTTTGGACAAGAGACG

TGGCCGGGACCCTGAGATGGGGGGAAAGCCGAGAAGGAAGAACCCTCAGG

AAGGCCTGTACAATGAACTGCAGAAAGATAAGATGGCGGAGGCCTACAGT

GAGATTGGGATGAAAGGCGAGCGCCGGAGGGGCAAGGGGCACGATGGCCT

TTACCAGGGTCTCAGTACAGCCACCAAGGACACCTACGACGCCCTTCACA

TGCAGGCCCTGCCCCCTCGCTAA

The isolated nucleic acid molecule having the nucleotide sequence of SEQ ID NO:951 encodes a FcRL-5-targeted CAR comprising a murine scFv that comprises a heavy chain variable region comprising amino acids having the sequence set forth in SEQ ID NO:915, a light chain variable region comprising amino acids having the sequence set forth in SEQ ID NO:917, and a linker having an amino acid sequence of SEQ ID NO:897 positioned between the heavy chain variable region and the light chain variable region, a transmembrane domain comprising a CD28 polypeptide, and an intracellular domain comprising a CD3ζ polypeptide and a co-stimulatory signaling region comprising a CD28 polypeptide.

In another specific non-limiting example, the isolated nucleic acid molecule comprises nucleic acids having the sequence set forth in SEQ ID NO:952 provided below:
ATGGAGACAGACACACTCCTGC-TATGGGTACTGCTGCTCTGGGTTCCAGGTTC-CACTGGTGACGTCCAACT GCAGGAGTCAGGGG-GAGGCTTAGTGCAGCCTGGAGGGTCCCGGAAACT CTCCTGTACAGCCTCTGGATTCA CTTTCAGTAGCTTTG-GAATGCACTGGGTTCGTCAGGCTCCAGAGAAGGG GCTGGAGTGGGTCGCATACATT AGTAGTGGCAGTAATAACATC-TACTTTGCGGACACAGTGAAGGGCCGATTCAC-CATCTCCAGAGACAATCC CAAGAACACCCTGTTCCTGCAAATGACCAGTCTA AGGTCTGAGGACACGGCCATGTATTACTGTGCAA-GAT CGGAATACTACGGTAGTAGCCATATGGAC-TACTGGGGCCAAGGGACCACGGT-CACCGTCTCCTCAGGTGGA GGTGGATCAGGTGGAGGTGGATCTGGTGGAGGTG-GATCTGACATTGAGCTCACCCAGTCTCCAAAATT-CAT GTCCACATCAGTAGGAGACAGGGTCAGCGT-CACCTGCAAGGCCAGTCAGAATGTGGGTACTAAT GTAGCCT GGTAT-CAACAGAAACCAGGACAATCTCCTAAACCACT-GATTTACTCGGCAACCTACCGGAACAGTGGAGTC CCTGATCGCTTCACAGGCAGTGGATCTGGGACA-GATTTCACTCTCACCAT-CACTAACGTGCAGTCTAAAGA CTTGGCAGACTAT-TTCTGTCAACAATATAACAGGTATCCGTACACGTC CGGAGGGGGGACCAAGCTGGAGA TCGAACAAAAACTCATCTCAGAAGAG-GATCTGGCGGCCGCAATTGAAGT-TATGTATCCTCCTCCTTACCTA GACAAT-GAGAAGAGCAATGGAACCATTATCCATGTGAAAGG-GAAACACCTTTGTCCAAGTCCCCTATTTCC CGGACCTTCTAAGCCCTTTTGGGTGCTGGTGGTG GTTGGTGGAGTCCTGGCTTGC-TATAGCTTGCTAGTAA CAGTGGCCTTTATTAT-TTTCTGGGTGAGGAGTAAGAG-GAGCAGGCTCCTGCACAGTGACTACATGAACATG ACTCCCCGCCGCCCGGGCCCACCCGCAAGCAT-TACCAGCCCTATGCCCCAC-CACGCGACTTCGCAGCCTA TCGCTCCAGAGT-GAAGTTCAGCAGGAGCGCAGACGCCCCCGCGTA CCAGCAGGGCCAGAACCAGCTCTATA ACGAGCT-CAATCTAGGACGAAGAGAGGAGTAC-GATGTTTTGGACAAGAGACGTGGCCGGGACCCT-GAGATG GGGGGAAAGCCGAGAAGGAAGAACCCTCAG-GAAGGCCTGTACAATGAACTGCAGAAAGATAA-GATGGCGGA GGCCTACAGTGAGATTGGGAT-GAAAGGCGAGCGCCGGAGGGGCAAGGGGCACGA TGGCCTTTACCAGGGTC TCAGTACAGCCAC-CAAGGACACCTACGACGCCCTTCA-CATGCAGGCCCTGCCCCCTCGCTAA [SEQ ID No: 952]. The isolated nucleic acid molecule having the nucleotide sequence of SEQ ID NO:952 encodes a FcRL-5-targeted CAR comprising a murine scFv that comprises a heavy chain variable region comprising amino acids having the sequence set forth in SEQ ID NO:919, a light chain variable region comprising amino acids having the sequence set forth in SEQ ID NO:921, and a linker having an amino acid sequence of SEQ ID NO:897 positioned between the heavy chain variable region and the light chain variable region, a transmembrane domain comprising a CD28 polypeptide, and an intracellular domain comprising a CD3ζ polypeptide and a co-stimulatory signaling region comprising a CD28 polypeptide.

In certain embodiments, the isolated nucleic acid molecule comprises nucleic acids having the sequence set forth in SEQ ID NO:953 provided below: CCGGTGGTACCT-CACCCT-TACCGAGTCGGCGACACAGTGTGGGTCCGCCGAC ACCAGACTAAGAACCTAGA ACCTCGCTG-GAAAGGACCTTACACAGTCCTGCTGACCACCCC-CACCGCCCTCAAAGTAGACGGCATCGCAG CTTG-GATACACGCCGCCCACGTGAAGGCTGCCGACCCC GGGGGTGGACCATCCTCTAGACTGCCATGGAAA CCGATA-CACTGCTGCTGTGGGTGCTGCTGCTGTGGGTGCCAG-GATCCACAGGCTCCTATGTGCTGACTCAG CCACCCTCAGTGTCAGTGGCCCCAGGAAA-GACGGCCAGGATTACCTGTGGGGAAACAACAT-TGGAAGTAA AAGTGTGCACTGGTACCAGCAGAAGCCAGGCCA GGCCCCTGTGCTGGTCATCTATTATGA-TAGCGACCGGC CCTCAGGGATCCCTGAGCGAT-TCTCTGGCTCCAACTCTGGGAACACGGC-CACCCTGACCATCAGCAGGGTC GAAGCCGGGGATGAGGCCGACTAT-TACTGTCAGGTGTGGGATAGTAGTAGTGAT-TATGTCTTCGGAACTGG GACCAAGGT-CACCGTCCTAGGTTCTAGAGGTGGTGGTGGTAGC GGCGGCGGCGGCTCTGGTGGTGGTGGAT CCCTCGAGATGGCCGAGGTGCAGCTGGTGGA-GACTGGGGGAGGCTTGGTCAAGCCTG-GAGGGTCCCTGAGA CTCTCCTGTGCAGCCTCTG-GATTCACCGTCAGTGACTACTACATGAGCTGGATC CGCCAGGCTCCAGGGAA GGGCCTGGAGTGGATTT-CATACATTAGTGGTAGTGGTAATAGCATATAC-TACGCAGACTCTGTGAAGGGCC GATTCAC-CATCTCCAGGGACAACGCCAAGAACTCACTGGAT CTGCAAATGACCAGCCT-GAGAGCCGAGGAC ACGGCCGTATATTACTGTGCGCGCTCTACTAAATTC-GATTACTGGGGTCAAGGTACTCTGGTGACCGTCTC CTCAGCGGCCGCACCCAC-CACGACGCCAGCGCCGCGACCAC-CAACCCCGGCGCCCACGATCGCGTCGCAGC CCCTGTCCCTGCGCCCAGAGGCGTGCCGGCCAGC GGCGGGGGGCGCAGTGCACACGAGGGGGCTGGA CTTC GCCTGTGATATCTA-CATCTGGGCGCCCCTGGCCGGGACTTGTGGGGTC CTTCTCCTGTCACTGGTTATCAC CCTT-TACTGCAACAAACGGGGCAGAAAGAAGCTCCTGT ATATATTCAAACAACCATTTATGAGACCAGTAC AAACTACTCAAGAGGAAGATGGCTGTAGCTGCC-GATTTCCAGAAGAAGAAGAAGGAGGATGTGAACT-GAGA GTGAAGTTCAGCAG-GAGCGCAGAGCCCCCGCGTACCAGCAGGGCCA GAACCAGCTCTATAACGAGCTCAA TCTAGGACGAAGAGAGGAGTAC-GATGTTTTGGACAAGAGACGTGGCCGGGACCCT-GAGATGGGGGGAAAGC CGAGAAGGAAGAACCCTCAGGAAGGCCTGTA-CAATGAACTGCAGAAAGATAAGATGGCGGAGGCC-TACAGT GAGATTGGGATGAAAGGCGAGCGCCG-GAGGGGCAAGGGGCACGATGGCCTTTACCAGGG TCTCAGTACAGC CACCAAGGACACC-TACGACGCCCTTCA-CATGCAGGCCCTGCCCCCTCGCTAACAGC-CACTCGAGGATCCGG ATTAGTCCAATTTGTTAAAGACAGGA-TATCAGTGGTCCAGGCTCTAGTTTTGACT-CAACAATATCACCAGC TGAAGCC-TATAGAGTACGAGCCATAGATAAAATAAAAGATTT TATTTAGTCTCCAGAAAAAGGGGGGAATG AAA-GACCCCACCTGTAGGTTTGGCAAGCTAGCT-TAAGTAACGCCATTTTGCAAGGCATGGAAAAATA-CATA ACTGAGAATAGAGAAGTTCAGATCAAGGTCAG-GAACAGATGGAACAGCTGAATATGGGCCAAACAG-GATAT CTGTGGTAAGCAGTTCCTGCCCCGGCTCAGGGC-CAAGAACAGATGGAACAGCTGAATATGGGC-CAAACAGG ATATCTGTGGTAAGCAGTTCCTGCCCCGGCTCAGG GCCAAGAACAGATGGTCCCCA-GATGCGGTCCAGCCC TCAGCAGTTTCTAGAGAAC-CATCAGATGTTTCCAGGGTGCCCCAAGGACCT-GAAATGACCCTGTGCCTTAT TTGAACTAAC-CAATCAGTTCGCTTCTCGCTTCTGTTCGCGCGCTT CTGCTCCCCGAGCTCAATAAAAGAGC CCACAACCCCTCACTCGGGGCGCCAGTCCTCCGAT-TGACTGAGTCGCCCGGGTACCCGTGTATC-CAATAAA CCCTCTTGCAGTTG-CATCCGACTTGTGGTCTCGCTGTTCCTTGGGAGG GTCTCCTCTGAGTGATTGACTAC CCGTCAGCGGGGTCTTTCACACATGCAG-CATGTATCAAAATTAATTTGGTTTTTTTTCTTAAGT-ATTTAC ATTAAATGGCCATAGTACTTAAAGTTACAT-TGGCTTCCTTGAAATAAACATGGAGTATTCAGAAT GTGTCA TAAATATTTCTAATTTTAAGATAGTATCTC-CATTGGCTTTCTACTTTTTCTTTTAT-TTTTTTTTGTCCTCT GTCTTCCAT-TTGTTGTTGTTGTTGTTTGTTTGTTTGTTTGTTGGT TGGTTGGTTAATTTTTTTTAAAGAT CCTACAC-TATAGTTCAAGCTAGACTATTAGC-TACTCTGTAACCCAGGGTGACCTTGAAGT-CATGGGTAGCC TGCTGTTTTAGCCTTCCCACATCTAAGATTA-CAGGTATGAGCTATCATTTTTGGTATATTGATTGATT- GAT TGATTGATGTGTGTGTGTGAT-
TGTGTTTGTGTGTGTGACTGTGAAAATGTGTGTAT
GGGTGTGTGTGAA
TGTGTGTATGTATGTGTGTGT-
GAGTGTGTGTGTGTGTGTG-
CATGTGTGTGTGTGACTGTGTCTAT
GTGTATGACTGTGTGTGTGTGTGTGTGTGTG
TGTGTGTGTGTGTGTGTGTGTTGTGAAAAAATATTC
TATGGTAGTGAGAGC-
CAACGCTCCGGCTCAGGTGTCAGGTTGGTTTTTGA-
GACAGAGTCTTTCACTTAGCT TGGAATT-
CACTGGCCGTCGTTTTACAACGTCGTGACTGGGA
AAACCCTGGCGTTACCCAACTTAATCGCCT
TGCAGCA-
CATCCCCCTTTCGCCAGCTGGCGTAATAGCGAAG
AGGCCCGCACCGATCGCCCTTCCCAACAGT
TGCGCAGCCTGAATGGCGAATGGCGCCT-
GATGCGGTATTTTCTCCTTACGCATCTGTGCGGTAT-
TTCACAC CGCATATGGTGCACTCTCAGTA-
CAATCTGCTCTGATGCCGCATAGTTAAGCCAGCCC
CGACACCCGCCAAC
ACCCGCTGACGCGCCCTGACGGGCTTGTCTGCTC
CCGGCATCCGCTTACA-
GACAAGCTGTGACCGTCTCCG GGAGCTG-
CATGTGTCAGAGGTTTTCACCGTCAT-
CACCGAAACGCGCGATGACGAAAGGGCCTCGTG
ATACG CCTATTTTTATAGGTTAATGTCATGA-
TAATAATGGTTTCTTA-
GACGTCAGGTGGCACTTTTCGGGGAAATG
TGCGCGGAACCCCTATTTGTTTATTTTTCTAAATA-
CATTCAAATATGTATCCGCTCATGAGACAATAACCC
TGATAAATGCTTCAATAATATT-
GAAAAAGGAAGAGTATGAGTATTCAACAT-
TTCCGTGTCGCCCTTATTCC CTTTTTTGCGGCAT-
TTTGCCTTCCTGTTTTTGCTCACCCAGAAACGCTG
GTGAAAGTAAAAGATGCTGAAG
ATCAGTTGGGTGCACGAGTGGGTTACATCGAACTG-
GATCTCAACAGCGGTAAGATCCTT-
GAGAGTTTTCGC CCCGAAGAACGTTTTCCAATGAT-
GAGCACTTTTAAAGTTCTGCTATGTGGCGCGGTAT
TATCCCGTATTGA
CGCCGGGCAAGAGCAACTCGGTCGCCGCATACAC-
TATTCTCAGAATGACTTGGTTGAGTACT-
CACCAGTCA CAGAAAAGCATCTTACGGATGG-
CATGACAGTAAGAGAATTATGCAGTGCTGCCATA
ACCATGAGTGATAAC ACTGCGGCCAACT-
TACTTCTGACAACGATCG-
GAGGACCGAAGGAGCTAACCGCTTTTTTGCACAA-
CATGGG
GGATCATGTAACTCGCCTTGATCGTTGGGAACCG-
GAGCTGAATGAAGCCATACCAAACGAC
GAGCGTGACA CCAC-
GATGCCTGTAGCAATGGCAACAACGTTGCGCAAAC-
TATTAACTGGCGAACTACTTACTCTAGCTTCC
CGGCAACAATTAATAGACTGGATGGAGGCGGA-
TAAAGTTGCAGGAC-
CACTTCTGCGCTCGGCCCTTCCGGC TGGCTGGTTT-
ATTGCTGATAAATCTGGAGCCGGTGAGCGTGGGT
CTCGCGGTATCATTGCAGCACTGGGGC
CAGATGGTAAGCCCTCCCGTATCGTAGTTATCTA-
CACGACGGGGAGTCAGGCAACTATGGAT-
GAACGAAAT AGACAGATCGCTGAGATAGGTGCCT-
CACTGATTAAGCATTGGTAACTGTCAGACCAAGTT
TACTCATATAT ACTTTAGATTGATTTAAAACTTCAT-
TTTTAATTTAAAAGGATCTAGGTGAAGATCCTTTT-
GATAATCTCA TGACCAAAATCCCTTAACGT-
GAGTTTTCGTTCCACTGAGCGTCAGACCCCGTAG
AAAAGATCAAAGGATCT TCTT-
GAGATCCTTTTTTTCTGCGCGTAATCTGCTGCTTG
CAAACAAAAAAACCACCGCTACCAGCGGTGGT
TTGTTTGCCGGATCAAGAGCTAC-
CAACTCTTTTTCCGAAGGTAACTGGCTTCAGCAG
AGCGCAGATACCAA
ATACTGTCCTTCTAGTGTAGCCGTAGTTAGGCCAC-
CACTTCAAGAACTCTGTAGCACCGCCTACATACCTC
GCTCTGCTAATCCTGT-
TACCAGTGGCTGCTGCCAGTGGCGA-
TAAGTCGTGTCTTACCGGGTTGGACTCAAG ACGA-
TAGTTACCGGATAAGGCGCAGCGGTCGGGCTGAA
CGGGGGGTTCGTGCACACAGCCCAGCTTGGAGC
GAACGACCTACACCGAACTGAGATACCTACAGCGT-
GAGCATTGAGAAAGCGCCACGCTTCCCGAAGG-
GAGA
AAGGCGGACAGGTATCCGGTAAGCGGCAGGGTCG-
GAACAGGAGAGCGCACGAGGGAGCTTCCAGGGG-
GAAA CGCCTGGTATCTT-
TATAGTCCTGTCGGGTTTCGCCACCTCTGACTTGA
GCGTCGATTTTGTGATGCTCGT CAGGGGGGCG-
AGCCTATG-
GAAAAACGCCAGCAACGCGGCCTTTT-
TACGGTTCCTGGCCTTTTGCTGGCCT
TTTGCTCACATGTTCTTTCCTGCGTTATCCCCTGAT
TCTGTGGATAACCGTATTACCGCCTTTGAGTGAGC
TGA-
TACCGCTCGCCGCAGCCGAACGACCGAGCGCAGC
GAGTCAGTGAGCGAGGAAGCGGAAGAGCGCCCAA
TACGCAAACCGCCTCTCCCCGCGCGTTGGCCGATT-
CAT-
TAATGCAGCTGGCACGACAGGTTTCCCGACTGG
AAAGCGGGCAGTGAGCGCAACGCAATTAATGT-
GAGTTAGCTCACTCATTAGGCACCCCAGGCTTTA-
CACTT TATGCTTCCGGCTCGTATGTTGTGTGGAAT-
TGTGAGCGGATAACAATTTCACACAGGAAACAGC
TATGACC ATGATTACGCCAAGCTTTGCTCTTAG-
GAGTTTCCTAATACATCCCAAACT-
CAAATATATAAAGCATTTGAC TTGTTC-
TATGCCCTAGGGGGCGGGGGGAAGCTAAGCCAGC
TTTTTTTAACATTTAAAATGTTAATTCCATT
TTAAATGCACAGATGTTTTTATTTCATAAGGGTTT-
CAATGTGCATGAATGCTGCAATATTCCTGTTACCAA
AGCTAGTATAAATAAAAATAGATAAACGTGGAAAT-
TACTTAGAGTTTCTGTCATTAACGTTTCCTTCCTCA
GTTGACAACATAAATGCGCTGCT-
GAGCAAGCCAGTTTGCATCTGTCAGGATCAAT-
TTCCCATTATGCCAGT CATATTAATTACTAGTCAATT-
AGTTGATTTTTATTTTTGACATATACATGTGAATGA
AAGACCCCACCTGT AGGTTTGGCAAGCTAGCT-
TAAGTAACGCCATTTTGCAAGGCATGGAAAAATA-
CATAACTGAGAATAGAAAA GTTCAGAT-
CAAGGTCAGGAACAGATGGAACAGCTGAATATGG
GCCAAACAGGATATCTGTGGTAAGCAGTT
CCTGCCCCGGCTCAGGGCCAAGAACAGATG-
GAACAGCTGAATATGGGCCAAACAGGA-
TATCTGTGGTAAGC
AGTTCCTGCCCCGGCTCAGGGCCAAGAACA-
GATGGTCCCCA-
GATGCGGTCCAGCCCTCAGCAGTTTCTAGA GAAC-
CATCAGATGTTTCCAGGGTGCCCCAAGGACCTGA
AATGACCCTGTGCCTTATTTGAACTAACCAATC
AGTTCGCTTCTCGCTTCTGTTCGCGCGCT-
TATGCTCCCCGAGCTCAATAAAAGAGCC-
CACAACCCCTCACT CGGGGCGCCAGTCCTCCGAT
TGACTGAGTCGCCCGGGTACCCGTGTATCCAATAA
ACCCTCTTGCAGTTGC
ATCCGACTTGTGGTCTCGCTGTTCCTTGG- GAGGGTCTCCTCTGAGTGATTGAC-
TACCCGTCAGCGGGGGTC TTTCAT-
TTGGGGGCTCGTCCGGGATCGGGAGACCCCTGCC
CAGGGACCACCGACCCACCACCGGGAGGTAA
GCTGGCCAGCAACTTATCTGTGTCTGTCCGAT-
TGTCTAGTGTCTATGACTGATTT-
TATGCGCCTGCGTCGG TACTAGT-
TAGCTAACTAGCTCTGTATCTGGCGGACCCGTGGT
GGAACTGACGAGTTCGGAACACCCGGCCG
CAACCCTGGGA-
GACGTCCCAGGGACTTCGGGGGCCGTTTTTGTGG
CCCGACCTGAGTCCTAAAATCCCGAT CGTT-
TAGGACTCTTTGGTGCACCCCCCTTAGAGGAGG-
GATATGTGGTTCTGGTAGGAGACGAGAACCTAAA
ACAGTTCCCGCCTCCGTCTGAAT-
TTTTGCTTTCGGTTTGGGACCGAAGCCGCGCCGC
GCGTCTTGTCTGCT GCAG-
CATCGTTCTGTGTTGTCTCTGTCTGACTGTGTTTC
TGTATTTGTCTGAAAATATGGGCCCGGGCTAG
ACTGTTACCACTCCCTTAAGTTTGACCTTAGGT-
CACTGGAAAGATGTCGAGCGGATCGCT-
CACAACCAGTC GGTAGATGTCAAGAAGA-
GACGTTGGGTTACCTTCTGCTCTGCAGAATGGCC
AACCTTTAACGTCGGATGGC CGCGA-
GACGGCACCTTTAACCGAGACCTCATCACCCAGGT-
TAAGATCAAGGTCTTTTCACCTGGCCCGCAT
GGACACCCAGACCAGGTCCCCTA-
CATCGTGACCTGG-
GAAGCCTTGGCTTTTGACCCCCCTCCCTGGGTCAA
GCCCTTTGTA-
CACCCTAAGCCTCCGCCTCCTCTTCCTC-
CATCCGCCCCGTCTCTCCCCCTTGAACCTCCTC
GTTCGACCCCGCCTCGATCCTCCCTT-
TATCCAGCCCTCACTCCTTCTCTAGGCGCCCC-
CATATGGCCATAT GAGATCT-
TATATGGGGCACCCCCGCCCCTTGTAAACTTCCCT
GACCCTGACATGACAAGAGTTACTAACAG
CCCCTCTCTCCAAGCTCACTTACAGGCTCTCTACT-
TAGTCCAGCACGAAGTCTGGA-
GACCTCTGGCGGCAG CCTAC-
CAAGAACAACTGGACCGA [SEQ ID No: 953]. The isolated nucleic acid molecule having the nucleotide sequence of SEQ ID NO:953 encodes a FcRL-5-targeted CAR (designated as 31 FcRL5-targeted BBz CAR) comprising a fully human scFv (encoded by nucleotides 207-998 of SEQ ID NO:953) that comprises a heavy chain variable region comprising amino acids having the sequence set forth in SEQ ID NO:116, a light chain variable region comprising amino acids having the sequence set forth in SEQ ID NO:115, and a linker having an amino acid sequence of SEQ ID NO:307 positioned between the heavy chain variable region and the light chain variable region, a transmembrane domain comprising a CD8 polypeptide having 137 to 207 of SEQ ID NO: 960, and an intracellular domain comprising a CD3ζ polypeptide comprising amino acids 52 to 163 of SEQ ID NO: 941, and a co-stimulatory signaling region comprising a 4-1BB polypeptide having amino acids 214-255 of SEQ ID NO: 943. Nucleotides 270-998 of SEQ ID NO: 953 encodes the human scFv. Nucleotides 1008-1220 of SEQ ID NO: 953 encodes the CD8 polypeptide comprised in the transmembrane domain. Nucleotides 1221-1346 of SEQ ID NO: 953 encodes the 4-1BB polypeptide comprised in the intracellular domain. Nucleotides 1347-1685 of SEQ ID NO: 953 encodes the CD3zeta polypeptide comprised in the intracellular domain. Other portions of SEQ ID NO: 953 are shown in Table 232.

TABLE 232

| Portions | Nucleotide Sequence Positions of SEQ ID NO: 953 | Number of Nucleotides |
|---|---|---|
| anti-FcRL5 scFv 31 | 207 . . . 998 | 792 |
| CD8a TM | 1008 . . . 1220 | 213 |
| 4-1BB | 1221 . . . 1346 | 126 |
| CD3zeta | 1347 . . . 1685 | 339 |
| LTR | 1965 . . . 2434 | 470 |
| M13 fwd | 3133 . . . 3149 | 17 |
| AmpR promoter | 3624 . . . 3728 | 105 |
| AmpR | 3729 . . . 4589 | 861 |
| ori | 4760 . . . 5348 | 589 |
| CAP binding site | 5636 . . . 5657 | 22 |
| lac promoter | 5672 . . . 5702 | 31 |
| lac operator | 5710 . . . 5726 | 17 |
| M13 rev | 5734 . . . 5750 | 17 |
| LTR | 6159 . . . 6752 | 594 |
| MMLV Psi | 6815 . . . 7172 | 358 |
| gag (truncated) | 7237 . . . 7653 | 417 |

In certain embodiments, the isolated nucleic acid molecule comprises nucleic acids having the sequence set forth in SEQ ID NO:954 provided below: CCGGTGGTACCT-
CACCCT-
TACCGAGTCGGCGACACAGTGTGGGTCCGCCGAC
ACCAGACTAAGAACCTAGA ACCTCGCTG-
GAAAGGACCTTACACAGTCCTGCTGACCACCCC-
CACCGCCCTCAAAGTAGACGGCATCGCAG CTTG-
GATACACGCCGCCCACGTGAAGGCTGCCGACCCC
GGGGGTGGACCATCCTCTAGACTGCCATGGAAA
CCGATA-
CACTGCTGCTGTGGGTGCTGCTGCTGTGGGTGCC
AGGATCCACAGGCAATTTTATGCTGACTCAG CCC-
CACTCTGTGTCGGAGTCTCCGGGGAA-
GACGGTAAC-
CATCTCCTGCACCCGCAGCAGTGGCAGCATTGC
CAGCAAC-
TATGTGCAGTGGTACCAGCAGCGCCCGGGCAGTT
CCCCCACCACTGTGATCTATGAGGATAACC AAA-
GACCCTCTGGGGTCCCTGATCGGTTCTCTGGCTC-
CATCGACAGCTCCTCCAACTCTGCCTCCCTCACC
ATCTCTGGACTGAAGACTGAGGACGAGGCTGAC-
TACTACTGTCAGTCTTATGATAGCAGCAAT-
TGGGTGTT CGGCGGAGGGAC-
CAAGCTGACCGTCCTAGGTTCTAGAGGTGGTGGT
GGTAGCGGCGGCGGCGGCTCTGGTG GTGGTG-
GATCCCTCGAGATGGCCGAGGTCCAGCTGGTGCA
GTCTGGGGCTGAGGTGAAGAAGCCTGGGTCC
TCGGTGAAGGTCTCCTGCAAGGCTTCTG-
GAGGCACCTTCAGCAGCTATGC-
TATCAGCTGGGTGCGACAGGC
CCCTGGACAAGGGCTTGAGTGGATGGGAGGGAT-
CATCCCTATCTTTGGTACAGCAAAC-
TACGCACAGAAGT TCCAGGGCAGAGTCACGAT-
TACCGCGGACGAATCCACGAGCACAGCCTACATG
GAGCTGAGCAGCCTGAGA TCT-
GAGGACACGGCCGTGTAT-
TACTGTGCGCGCTCTAACTACTACTACAACGAT-
TACTGGGGTCAAGGTAC
TCTGGTGACCGTCTCCTCAGCGGCCGCACCCAC-
CACGACGCCAGCGCCGCGACCAC-
CAACCCCGGCGCCCA
CGATCGCGTCGCAGCCCCTGTCCCTGCGCCCAGA
GGCGTGCCGGCCAGCGGCGGGGGGCGCAGTGCA
CACG AGGGGGCTGGACTTCGCCTGTGATATCTA-
CATCTGGGCGCCCCTGGCCGGGACTTGTGGGGTC
CTTCTCCT GTCACTGGTTATCACCCTT-
TACTGCAACAAACGGGGCAGAAAGAAGCTCCTGT
ATATATTCAAACAACCAT TTATGAGACCAGTA-
CAAACTACTCAAGAGGAAGATGGCTGTAGCTGCC-
GATTTCCAGAAGAAGAAGAAGGA GGATGTGAACTGAGAGTGAAGTTCAGCAG-
GAGCGCAGAGCCCCCCGCGTACCAGCAGGGCCA
GAACCAGCT CTATAACGAGCT-
CAATCTAGGACGAAGAGAGGAGTAC-
GATGTTTTGGACAAGAGACGTGGCCGGGACCCTG
AGATGGGGG-
GAAAGCCGAGAAGGAAGAACCCTCAG-
GAAGGCCTGTACAATGAACTGCAGAAAGATAA-
GATG
GCGGAGGCCTACAGTGAGATTGGGAT-
GAAAGGCGAGCGCCGGAGGGGCAAGGGGCAC-
GATGGCCTTTACCA GGGTCTCAGTACAGCCAC-
CAAGGACACCTACGACGCCTTCACATGCAGGCC
CTGCCCCCTCGCTAACAGC CACTCGAGGATCCG-
GATTAGTCCAATTTGTTAAAGACAGGA-
TATCAGTGGTCCAGGCTCTAGTTTTGACTC
AACAATATCACCAGCTGAAGCC-
TATAGAGTACGAGCCATAGATAAAATAAAAGATTTT-
ATTTAGTCTCCAG AAAAAGGGGGAATGAAA-
GACCCCACCTGTAGGTTTGGCAAGCTAGCTTAAG
TAACGCCATTTTGCAAGGC ATGGAAAAATACAT-
AACTGAGAATAGAGAAGTTCAGATCAAGGTCAG-
GAACAGATGGAACAGCTGAATATG GGCCAAACAG-
GATATCTGTGGTAAGCAGTTCCTGCCCCGGCTCAG
GGCCAAGAACAGATGGAACAGCTGAA TATGGGC-
CAAACAGGA-
TATCTGTGGTAAGCAGTTCCTGCCCCGGCTCAGGG
CCAAGAACAGATGGTCCCCA
GATGCGGTCCAGCCCTCAGCAGTTTCTAGAGAAC-
CATCAGATGTTTCCAGGGTGCCCCAAGGACCT-
GAAAT GACCCTGTGCCTTATTTGAACTAAC-
CAATCAGTTCGCTTCTCGCTTCTGTTCGCGCGCTT
CTGCTCCCCGA GCTCAATAAAAGAGCC-
CACAACCCCTCACTCGGGGCGCCAGTCCTCCGAT-
TGACTGAGTCGCCCGGGTACC CGTGTATC-
CAATAAACCCTCTTGCAGTTGCATCCGACTTGTGG
TCTCGCTGTTCCTTGGGAGGGTCTCCTC TGAGT-
GATTGACTACCCGTCAGCGGGGGTCTTTCACA-
CATGCAGCATGTATCAAAATTAATTTGGTTTTTT
TTCTTAAGTATTTACATTAAATGGCCATAGTACT-
TAAAGTTACATTGGCTTCCTTGAAATAAACATG-
GAGT ATTCAGAATGTGTCATAAATATTTCTAATTT-
TAAGATAGTATCTCCATTGGCTTTCTACTTTTTCTT
TTAT TTTTTTTTGTCCTCTGTCTTCCAT-
TTGTTGTTGTTGTTTGTTTGTTTGTTTGTTGGT
TGGTTGGTTAA TTTTTTTTTAAAGATCCTACAC-
TATAGTTCAAGCTAGACTATTAGC-
TACTCTGTAACCCAGGGTGACCTTG AAGT-
CATGGGTAGCCTGCTGTTTTAGCCTTCCCACATCT
AAGATTACAGGTATGAGCTATCATTTTTGGTA TATT-
GATTGATTGATTGATTGATGTGTGTGTGTGTGAT-
TGTGTTTGTGTGTGTGACTGTGAAAATGTGTGT
ATGGGTGTGTGT-
GAATGTGTGTATGTATGTGTGTGTGT-
GAGTGTGTGTGTGTGTGTGCATGTGTGTGTG
TGTGACTGTGTC-
TATGTGTATGACTGTGTGTGTGTGTGTGTGTGTGT
GTGTGTGTGTGTGTGTGTGTGT TGTGAAAAAAT-
ATTCTATGGTAGTGAGAGC-
CAACGCTCCGGCTCAGGTGTCAGGTTGGTTTTTGA-
GACAGA
GTCTTTCACTTAGCTTGGAATT-
CACTGGCCGTCGTTTACAACGTCGTGACTGG-
GAAAACCCTGGCGTTAC CCAACT-
TAATCGCCTTGCAGCACATCCCCCTTTCGCCAGCT
GGCGTAATAGCGAAGAGGCCCGCACCGATC
GCCCTTCCCAACAGTTGCGCAGCCT-
GAATGGCGAATGGCGCCTGATGCGGTAT-
TTTCTCCTTACGCATCTG
TGCGGTATTTCACACCG-
CATATGGTGCACTCTCAGTACAATCTGCTCT-
GATGCCGCATAGTTAAGCCAGCC CCGACACCCGC-
CAACACCCGCTGACGCGCCCTGACGGGCTTGTCT
GCTCCCGGCATCCGCTTACAGACAAG
CTGTGACCGTCTCCGGGAGCTG-
CATGTGTCAGAGGTTTTCACCGTCAT-
CACCGAAACGCGCGATGACGAAAGGGCCTCGTGA-
TACGCCTATTTTTATAGGTTAATGTCATGATAATAAT
GGTTTCTTAGACGTCAGGTGGCA CTTTTCGGG-
GAAATGTGCGCGGAACCCCTATTTGTTTAT-
TTTTCTAAATACATTCAAATATGTATCCGCTC ATGA-
GACAATAACCCTGATAAATGCTTCAATAATATTGA
AAAAGGAAGAGTATGAGTATTCAACATTTCCG
TGTCGCCCTTATTCCCTTTTTTGCGGCAT-
TTTGCCTTCCTGTTTTTGCT-
CACCCAGAAACGCTGGTGAAAG TAAAAGATGCT-
GAAGATCAGTTGGGTGCACGAGTGGGTTACATCG
AACTGGATCTCAACAGCGGTAAGATC CTT-
GAGAGTTTTCGCCCCGAAGAACGTTTTCCAATGAT-
GAGCACTTTTAAAGTTCTGCTATGTGGCGCGGT
ATTCCCGTAT-
TGACGCCGGGCAAGAGCAACTCGGTCGCCGCATA-
CACTATTCTCAGAATGACTTGGTTG AGTACT-
CACCAGTCACAGAAAAGCATCTTACGGATGGCAT
GACAGTAAGAGAATTATGCAGTGCTGCCATA
ACCATGAGTGATAACACTGCGGCCAACT-
TACTTCTGACAACGATCG-
GAGGACCGAAGGAGCTAACCGCTTT TTTGCACAA-
CATGGGGGATCATGTAACTCGCCTTGATCGTTGGG
AACCGGAGCTGAATGAAGCCATACCAA
ACGACGAGCGTGACACCAC-
GATGCCTGTAGCAATGGCAACAACGTTGCGCAAAC-
TATTAACTGGCGAACTA
CTTACTCTAGCTTCCCGGCAACAATTAATAGACTG-
GATGGAGGCGGATAAAGTTGCAGGAC-
CACTTCTGCG CTCGGCCCTTCCGGCTGGCTGGTTT-
ATTGCTGATAAATCTGGAGCCGGTGAGCGTGGGT
CTCGCGGTATCA TTGCAGCACTGGGGCCA-
GATGGTAAGCCCTCCCGTATCGTAGTTATCTA-
CACGACGGGGAGTCAGGCAACT ATGGAT-
GAACGAAATAGACAGATCGCTGAGATAGGTGCCT
CACTGATTAAGCATTGGTAACTGTCAGACCA AGTT-
TACTCATATATACTTTAGATTGATTTAAAACTTCAT-
TTTTAATTTAAAAGGATCTAGGTGAAGATCC TTTTT-
GATAATCTCATGACCAAAATCCCTTAACGTGAGTT
TTCGTTCCACTGAGCGTCAGACCCCGTAGAA
AAGATCAAAGGATCTTCTT-
GAGATCCTTTTTTTCTGCGCGTAATCTGCTGCTTG
CAAACAAAAAAACCACC
GCTACCAGCGGTGGTTTGTTTGCCGGATCAAGAGC-
TAC-
CAACTCTTTTTCCGAAGGTAACTGGCTTCAGCA
GAGCGCAGATAC-
CAAATACTGTCCTTCTAGTGTAGCCGTAGTTAGGC-
CACCACTTCAAGAACTCTGTAGCA CCGCCTACAT-
ACCTCGCTCTGCTAATCCTGTTACCAGTGGCTGCT
GCCAGTGGCGATAAGTCGTGTCTTAC
CGGGTTGGACTCAAGACGATAGTTACCGGA-
TAAGGCGCAGCGGTCGGGCT-
GAACGGGGGGTTCGTGCACAC AGCCCAGCTTG-
GAGCGAACGACCTACACCGAACTGAGATACCTAC
AGCGTGAGCATTGAGAAAGCGCCACG
CTTCCCGAAGG-
GAGAAAGGCGGACAGGTATCCGGTAAGCGGCAG
GGTCG- GAACAGGAGAGCGCACGAGGGA GCTTCCAGGGG-
GAAACGCCTGGTATCTTTATAGTCCTGTCGGGTTT
CGCCACCTCTGACTTGAGCGTCGAT TTTTGT-
GATGCTCGTCAGGGGGCGGAGCCTATG-
GAAAAACGCCAGCAACGCGGCCTTTT-
TACGGTTCCTG
GCCTTTTGCTGGCCTTTTGCTCA-
CATGTTCTTTCCTGCGTTATCCCCTGATTCTGTGGA-
TAACCGTATTAC CGCCTTTGAGTGAGCTGA-
TACCGCTCGCCGCAGCCGAACGACCGAGCGCAG
CGAGTCAGTGAGCGAGGAAG CGGAAGAGCGCC-
CAATACGCAAACCGCCTCTCCCCGCGCGTTGGCC-
GATTCATTAATGCAGCTGGCACGAC
AGGTTTCCCGACTGGAAAGCGGGCAGT-
GAGCGCAACGCAATTAATGTGAGTTAGCTCACT-
CATTAGGCACC CCAGGCTTTACACTT-
TATGCTTCCGGCTCGTATGTTGTGTGGAATTGTGA
GCGGATAACAATTTCACACAG GAAACAGC-
TATGACCATGATTACGCCAAGCTTTGCTCTTAG-
GAGTTTCCTAATACATCCCAAACTCAAATA
TATAAAGCATTTGACTTGTTC-
TATGCCCTAGGGGGCGGGGG-
GAAGCTAAGCCAGCTTTTTTTAACATTTAA AATGT-
TAATTCCATTTTAAATGCACAGATGTTTTTATTTCAT
AAGGGTTTCAATGTGCATGAATGCTGCAA TAT-
TCCTGTTACCAAAGCTAGTATAAATAAAAATAGA-
TAAACGTGGAAATTACTTAGAGTTTCTGTCATTA
ACGTTTCCTTCCTCAGTTGACAACAT-
AAATGCGCTGCTGAGCAAGCCAGTTTG-
CATCTGTCAGGATCAATT TCCCATTATGCCAGTCAT-
ATTAATTACTAGTCAATTAGTTGATTTTTATTTTTG
ACATATACATGTGAATG AAAGACCC-
CACCTGTAGGTTTGGCAAGCTAGCTTAAGTAACGC-
CATTTTGCAAGGCATGGAAAAATACATA ACT-
GAGAATAGAAAAGTTCAGATCAAGGTCAGGAAC
AGATGGAACAGCTGAATATGGGCCAAACAGGATAT
CTGTGGTAAGCAGTTCCTGCCCCGGCTCAGGGC-
CAAGAACAGATGGAACAGCTGAATATGGGC-
CAAACAGG
ATATCTGTGGTAAGCAGTTCCTGCCCCGGCTCAGG
GCCAAGAACAGATGGTCCCCA-
GATGCGGTCCAGCCC TCAGCAGTTTCTAGAGAAC-
CATCAGATGTTTCCAGGGTGCCCCAAGGACCT-
GAAATGACCCTGTGCCTTAT
TTGAACTAAC-
CAATCAGTTCGCTTCTCGCTTCTGTTCGCGCGCT-
TATGCTCCCCGAGCTCAATAAAAGAGC
CCACAACCCCTCACTCGGGGCGCCAGTCCTCCGAT-
TGACTGAGTCGCCCGGGTACCCGTGTATC-
CAATAAA CCCTCTTGCAGTTG-
CATCCGACTTGTGGTCTCGCTGTTCCTTGGGAGG
GTCTCCTCTGAGTGATTGACTAC
CCGTCAGCGGGGGTCTTTCAT-
TTGGGGGCTCGTCCGGGATCGGA-
GACCCCTGCCCAGGGACCACCGACCC ACCACCGG-
GAGGTAAGCTGGCCAGCAACTTATCTGTGTCTGTC
CGATTGTCTAGTGTCTATGACTGATTTT
ATGCGCCTGCGTCGGTACTAGT-
TAGCTAACTAGCTCTGTATCTGGCGGACCCGTGGT
GGAACTGACGAGTT
CGGAACACCCGGCCGCAACCCTGGGA-
GACGTCCCAGGGACTTCGGGGGCCGTTTTTGTGG
CCCGACCTGAG TCCTAAAATCCCGATCGTT-
TAGGACTCTTTGGTGCACCCCCCTTAGAGGAGG-
GATATGTGGTTCTGGTAGG
AGACGAGAACCTAAAACAGTTCCCGCCTCCGTCT-
GAAT-
TTTTGCTTTCGGTTTGGGACCGAAGCCGCGCCG
CGCGTCTTGTCTGCTGCAG-
CATCGTTCTGTGTTGTCTCTGTCTGACTGTGTTTCT
GTATTTGTCTGAAAAT ATGGGCCCGGGCTA-
GACTGTTACCACTCCCTTAAGTTTGACCTTAGGT-
CACTGGAAAGATGTCGAGCGGAT CGCT-
CACAACCAGTCGGTAGATGTCAAGAAGAGACGTT
GGGTTACCTTCTGCTCTGCAGAATGGCCAACCT
TTAACGTCGGATGGCCGCGAGACGGCACCTT-
TAACCGAGACCTCATCACCCAGGTTAAGAT-
CAAGGTCTTT TCACCTGGCCCGCATGGACACCCA-
GACCAGGTCCCCTACATCGTGACCTGGGAAGCCT
TGGCTTTTGACCC CCCTCCCTGGGT-
CAAGCCCTTTGTA-
CACCCTAAGCCTCCGCCTCCTCTTCCTC-
CATCCGCCCCGTCTCTCC
CCCTTGAACCTCCTCGTTCGACCCCGCCTC-
GATCCTCCCTTTATCCAGCCCT-
CACTCCTTCTCTAGGCGCC CCCATATGGCCATAT-
GAGATCTTATATGGGGCACCCCCGCCCCTTGTAAA
CTTCCCTGACCCTGACATGAC AAGAGT-
TACTAACAGCCCCTCTCTCCAAGCTCACTTA-
CAGGCTCTCTACTTAGTCCAGCACGAAGTCTGGA
GACCTCTGGCGGCAGCCTAC-
CAAGAACAACTGGACCGA [SEQ ID NO: 954]. The isolated nucleic acid molecule having the nucleotide sequence of SEQ ID NO:954 encodes a FcRL-5-targeted CAR (designated as 39 FcRL5-targeted BBz CAR) comprising a fully human scFv (encoded by nucleotides 207-1013 of SEQ ID NO:954) that comprises a heavy chain variable region comprising amino acids having the sequence set forth in SEQ ID NO:144, a light chain variable region comprising amino acids having the sequence set forth in SEQ ID NO:143, and a linker having an amino acid sequence of SEQ ID NO:307 positioned between the heavy chain variable region and the light chain variable region, a transmembrane domain comprising a CD8 polypeptide having 137 to 207 of SEQ ID NO: 960, and an intracellular domain comprising a CD3ζ polypeptide comprising amino acids 52 to 163 of SEQ ID NO: 941, and a co-stimulatory signaling region comprising a 4-1BB polypeptide having amino acids 214-255 of SEQ ID NO: 943. Nucleotides 207-1013 of SEQ ID NO: 954 encodes the human scFv. Nucleotides 1023-1235 of SEQ ID NO: 954 encodes the CD8 polypeptide comprised in the transmembrane domain. Nucleotides 1236-1361 of SEQ ID NO: 954 encodes the 4-1BB polypeptide comprised in the intracellular domain. Nucleotides 1362-1700 of SEQ ID NO: 954 encodes the CD3zeta polypeptide comprised in the intracellular domain. Other portions of SEQ ID NO: 954 are shown in Table 233.

TABLE 233

| Portions | Nucleotide Sequence Positions of SEQ ID NO: 954 | Number of Nucleotides |
|---|---|---|
| anti-FcRL5 scFv 39 | 207 . . . 1013 | 807 |
| CD8a TM | 1023 . . . 1235 | 213 |
| 4-1BB | 1236 . . . 1361 | 126 |
| CD3zeta | 1362 . . . 1700 | 339 |
| LTR | 1980 . . . 2449 | 470 |
| M13 fwd | 3148 . . . 3164 | 17 |
| AmpR promoter | 3639 . . . 3743 | 105 |
| AmpR | 3744 . . . 4604 | 861 |
| ori | 4775 . . . 5363 | 589 |
| CAP binding site | 5651 . . . 5672 | 22 |
| lac promoter | 5687 . . . 5717 | 31 |

TABLE 233-continued

| Portions | Nucleotide Sequence Positions of SEQ ID NO: 954 | Number of Nucleotides |
|---|---|---|
| lac operator | 5725 ... 5741 | 17 |
| M13 rev | 5749 ... 5765 | 17 |
| LTR | 6174 ... 6767 | 594 |
| MMLV Psi | 6830 ... 7187 | 358 |
| gag (truncated) | 7252 ... 7668 | 417 |

In certain embodiments, the isolated nucleic acid molecule comprises nucleic acids having the sequence set forth in SEQ ID NO:955 provided below: CCGGTGGTACCTCACCCTTACCGAGTCGGCGACACAGTGTGGGTCCGCCGACACCAGACTAAGAACCTAGA ACCTCGCTGGAAAGGACCTTACACAGTCCTGCTGACCACCCCACCGCCCTCAAAGTAGACGGCATCGCAG CTTGGATACACGCCGCCCACGTGAAGGCTGCCGACCCCGGGGGTGGACCATCCTCTAGACTGCCATGGAAACCGACACCCTGCTGCTGTGGGTGCTGCTGCTGTGGGTGCCAGGATCCACAGGACAGTCTGTCGTGACGCAGCCACCCTCAGCGTCTGGGACCCCCGGGCAGAGGGTCACCATCTCTTGTTCTGGAAGCAGCTCCAACATCGG AAGTAATTATGTATACTGGTACCAGCAGCTCCCAGGAACGGCCCCCAAACTCCTCATCTATAGTAATAATCAGCGGCCCTCAGGGGTCCCTGACCGATTCTCTGGCTCCAAGTCTGGCACCTCAGCCTCCCTGGCCATCAGTGGGCTCCGGTCCGAGGATGAGGCTGATTATTACTGTGCAGCATGGGATGACAGCCTGAGTGGTTATGTCTT CGGAACTGGGACCAAGCTGACCGTCCTAGGTTCTAGAGGTGGTGGTGGTAGCGGCGGCGGCGGCTCTGGTG GTGGTGGATCCCTCGAGATGGCCCAGGTGCAGCTACAGCAGTGGGGCGCAGGACTGTTGAAGCCTTCGGAGACCCTGTCCCTCACCTGCGCTGTCTATGGTGGGTCCTTCAGGGTTACTACTGGAGCTGGATCCGCCAGCC CCCAGGGAAGGGGCTGGAGTGGATTGGGGAAATCAATCATAGTGGAAGCACCAACTACAACCCGTCCCTCA AGAGTCGAGTCACCATATCAGTAGACACGTCCAAGAACCAGTTCTCCCTGAAGCTGAGCTCTGTGACCGCCGCGGACACGGCCGTGTATTACTGTGCGCGCCTGTACGAAGGTGGTTACCATGGTTGGGGTTCTTGGCTGTC TTCTGATTCTTGGGGTCAAGGTACTCTGGTGACCGTCTCCTCAGCGGCCGCACCCACCACGACGCCAGCGC CGCGACCACCAACCCCGGCGCCCACGATCGCGTCGCAGCCCCTGTCCCTGCGCCCAGAGGCGTGCCGGCCAGCGGCGGGGGGCGCAGTGCACACGAGGGGGCTGGACTTCGCCTGTGATATCTACATCTGGGCGCCCCTGGCCGGGACTTGTGGGGTCCTTCTCCTGTCACTGGTTATCACCCTTTACTGCAACAAACGGGGCAGAAAGAAGCTCCTGTATATATTCAAACAACCATTTATGAGACCAGTACAAACTACTCAAGAGGAAGATGGCTGTAGCTGC CGATTTCCAGAAGAAGAAGAAGGAGGATGTGAACTGAGAGTGAAGTTCAGCAGGAGCGCAGAGCCCCCGCGTACCAGCAGGGCCAGAACCAGCTCTATAACGAGCTCAATCTAGGACGAAGAGAGGAGTACGATGTTTTGG ACAAGAGACGTGGCCGGGACCCTGAGATGGGGGGAAAGCCGAGAAGGAAGAACCCTCAGGAAGGCCTGTACAATGAACTGCAGAAAGATAAGATGGCGGAGGCCTACAGTGAGATTGGGATGAAAGGCGAGCGCCGGAGGGG CAAGGGGCACGATGGCCTTTACCAGGGTCTCAGTACAGCCACCAAGGACACCTACGACGCCCTTCACATGC AGGCCCTGCCCCCTCGCTAACAGCCACTCGAGGATCCGGATTAGTCCAATTTGTTAAAGACAGGATATCAG TGGTCCAGGCTCTAGTTTTGACTCAACAATATCACCAGCTGAAGCCTATAGAGTACGAGCCATAGATAAAA TAAAAGATTTTATTTAGTCTCCAGAAAAAGGGGGGAATGAAAGACCCCACCTGTAGGTTTGGCAAGCTAGC TTAAGTAACGCCATTTTGCAAGGCATGGAAAAATACATAACTGAGAATAGAGAAGTTCAGATCAAGGTCAG GAACAGATGGAACAGCTGAATATGGGCCAAACAGGATATCTGTGGTAAGCAGTTCCTGCCCCGGCTCAGGG CCAAGAACAGATGGAACAGCTGAATATGGGCCAAACAGGATATCTGTGGTAAGCAGTTCCTGCCCCGGCTC AGGGCCAAGAACAGATGGTCCCCAGATGGTCCAGCCCTCAGCAGTTTCTAGAGAACCATCAGATGTTTC CAGGGTGCCCCAAGGACCTGAAATGACCCTGTGCCTTATTTGAACTAACCAATCAGTTCGCTTCTCGCTTC TGTTCGCGCGCTTCTGCTCCCCGAGCTCAATAAAAGAGCCCACAACCCCTCACTCGGGGCGCCAGTCCTCC GATTGACTGAGTCGCCCGGGTACCCGTGTATCCAATAAACCCTCTTGCAGTTGCATCCGACTTGTGGTCTC GCTGTTCCTTGGGAGGGTCTCCTCTGAGTGATTGACTACCCGTCAGCGGGGGTCTTTCACACATGCAGCAT GTATCAAAATTAATTTGGTTTTTTTTCTTAAGTATTTACATTAAATGGCCATAGTACTTAAAGTTACATTG GCTTCCTTGAAATAAACATGGAGTATTCAGAATGTGTCATAAATATTTCTAATTTTAAGATAGTATCTCCA TTGGCTTTCTACTTTTTCTTTTATTTTTTTTGTCCTCTGTCTTCCATTTGTTGTTGTTGTTGTTTGTTTG TTTGTTTGTTGGTTGGTTGGTTAATTTTTTTTTAAAGATCCTACACTATAGTTCAAGCTAGACTATTAGCT ACTCTGTAACCCAGGGTGACCTTGAAGTCATGGGTAGCCTGCTGTTTTAGCCTTCCCACATCTAAGATTAC AGGTATGAGCTATCATTTTTGGTATATTGATTGATTGATTGATTGATGTGTGTGTGTGTGATTGTGTTTGT GTGTGTGACTGTGAAAATGTGTGTATGGGTGTGTGTGAATGTGTGTATGTATGTGTGTGTGAGTGTGTGTGTGTGTGTGCATGTGTGTGTGTGACTGTGTCTATGTGTATGACTGTGTGTGTGTGTGTGTGTGTGTGTGTGTGTGTGTGTGTGTGTTGTGAAAAAATATTCTATGGTAGTGAGAGCCAACGCTCCGGCTCAGG TGTCAGGTTGGTTTTTGAGACAGAGTCTTTCACTTAGCTTGGAATTCACTGGCCGTCGTTTACAACGTCG TGACTGGGAAAACCCTGGCGTTACCCAACTTAATCGCCTTGCAGCACATCCCCTTTCGCCAGCTGGCGTA ATAGCGAAGAGGCCCGCACCGATCGCCCTTCCAACAGTTGCGCAGCCTGAATGGCGAATGGCGCCTGATG CGGTATTTTCTCCTTACGCATCTGTGCGGTATTTCACACCGCATATGGTGCACTCTCAGTACAATCTGCTCTGATGCCGCATAGTTAAGCCAGCCCCGACACCCGC CAACACCCGCTGACGCGCCCTGACGGGCTTGTCTGC TCCCGGCATCCGCTTACAGACAAGCTGTGACCGTCTCCGGGAGCTGCATGTGTCAGAGGTTTTCACCGTCA TCACCGAAACGCGCGATGACGAAAGGGCCTCGTGATACGCCTATTTTTATAGGTTAATGTCATGATAATAA TGGTTTCTTAGACGTCAGGTGGCACTTTTCGGGGAAATGTGCGCGGAACCCCTATTTGTTTATTTTTCTAAATACATTCAAATATGTATCCGCTCATGAGACAATAACCCTGATAAATGCTTCAATAATATTGAAAAAGGAA GAGTATGAGTATTCAACATTTCCGTGTCGCCCTTATTCCCTTTTTTGCGGCATTTTGCCTTCCTGTTTTTG CTCACCCAGAAACGCTGGTGAAAGTAAAAGATGCTGAA GATCAGTTGGGTGCACGAGTGGGTTACATCGAA CTGGATCTCAACAGCGGTAAGATCCTTGAGAGTTTTCGCCCCGAAGAACGTTTTCCAATGATGAGCACTTT TAAAGTTCTGCTATGTGGCGCGGTATTATCCCGTATTGACGCCGGGCAAGAGCAACTCGGTCGCCGCATAC ACTATTCTCAGAATGACTTGGTTGAGTACTCACCAGTCACAGAAAAGCATCTTACGGATGGCATGACAGTA AGAGAATTATGCAGTGCTGCCATAACCATGAGTGATAACACTGCGGCCAACTTACTTCTGACAACGATCGG AGGACCGAAGGAGCTAACCGCTTTTTTGCACAACATGGGGGATCATGTAACTCGCCTTGATCGTTGGGAAC CGGAGCTGAATGAAGCATACCAAACGACGAGCGTGACACCACGATGCCTGTAGCAATGGCAACAACGTTG CGCAAACTATTAACTGGCGAACTACTTACTCTAGCTTCCCGGCAACAATTAATAGACTGGATGGAGGCGGA TAAAGTTGCAGGACCACTTCTGCGCTCGGCCCTTCCGGCTGGCTGGTTTATTGCTGATAAATCTGGAGCCG GTGAGCGTGGGTCTCGCGGTATCATGCAGCACTGGGGCCAGATGGTAAGCCCTCCCGTATCGTAGTTATC TACACGACGGGGAGTCAGGCAACTATGGATGAACGAAATAGACAGATCGCTGAGATAGGTGCCTCACTGAT TAAGCATTGGTAACTGTCAGACCAAGTTTACTCATATATACTTTAGATTGATTTAAAACTTCATTTTTAAT TTAAAAGGATCTAGGTGAAGATCCTTTTTGATAATCTCATGACCAAAATCCCTTAACGTGAGTTTTCGTTC CACTGAGCGTCAGACCCCGTAGAAAAGATCAAAGGATCTTCTTGAGATCCTTTTTTTCTGCGCGTAATCTG CTGCTTGCAAACAAAAAAACCACCGCTACCAGCGGTGGTTTGTTTGCCGGATCAAGAGCTACCAACTCTTT TTCCGAAGGTAACTGGCTTCAGCAGAGCGCAGATACCAAATACTGTCCTTCTAGTGTAGCCGTAGTTAGGC CACCACTTCAAGAACTCTGTAGCACCGCCTACATACCTCGCTCTGCTAATCCTGTTACCAGTGGCTGCTGC CAGTGGCGATAAGTCGTGTCTTACCGGGTTGGACTCAAGACGATAGTTACCGGATAAGGCGCAGCGGTCGG GCTGAACGGGGGGTTCGTGCACACAGCCCAGCTTGGAGCGAACGACCTACACCGAACTGAGATACCTACAG CGTGAGCATTGAGAAAGCGCCACGCTTCCCGAAGGGAGAAAGGCGGACAGGTATCCGGTAAGCGGCAGGGT CGGAACGAGAGCGCACGAGGGAGCTTCCAGGGGGAAACGCCTGGTATCTTTATAGTCCTGTCGGGTTTC GCCACCTCTGACTTGAGCGTCGATTTTTGTGATGCTCGTCAGGGGGCGGAGCCTATGGAAAAACGCCAGCAACGCGGCCTTTT TACGGTTCCTGGCCTTTTGCTGGCCTTTTGCTCACATGTTCTTTCCTGCGTTATCCCC TGATTCTGTGGATAACCGTATTACCGCCTTTGAGTGAGCTGATACCGCTCGCCGCAGCCGAACGACCGAGC GCAGCGAGTCAGTGAGCGAGGAAGCGGAAGAGCGCC CAATACGCAAACCGCCTCTCCCCGCGCGTTGGCCGATTCAT TAATGCAGCTGGCACGACAGGTTTCCCGACTGGAAAGCGGGCAGTGAGCGCAACGCAATTAATGT GAGTTAGCTCACTCATTAGGCACCCCAGGCTTTACACTTTATGCTTCCGGCTCGTATGTTGTGTGGAATTG TGAGCGGATAACAATTTCACACAGGAAACAGCTATGACCATGATTACGCCAAGCTTTGCTCTTAGGAGTTT CCTAATACATCCCAAACTCAAATATATAAAGCATTTGACTTGTTCTATGCCCTAGGGGCGGGGGGAAGCT AAGCCAGCTTTTTTAACATTTAAAATGTTAATTCCATTTTAAATGCACAGATGTTTTTATTTCATAAGGG TTTCAATGTGCATGAATGCTGCAATATTCCTGTTACCAAAGCTAGTATAAATAAAAATAGATAAACGTGGA AATTACTTAGAGTTTCTGTCATTAACCTTTCCTTCCTCAGTTGACAACATAAATGCGCTGCTGAGCAAGCC AGTTTGCATCTGTCAGGATCAATTTCCCATTATGCCAGTCAT ATTAATTACTAGTCAATTAGTTGATTTTT ATTTTTGACATATACATGTGAATGAAAGACCCCACCTGTAGGTTTGGCAAGCTAGCTTAAGTAACGCCATT TTGCAAGGCATGGAAAAATACATAACTGAGAATAGAAAAGTTCAGATCAAGGTCAGGAACAGATGGAACAG CTGAATATGGGCCAAACAGGATATCTGTGGTAAGCAGTTCCTGCCCCGGCTCAGGGCCAAGAACAGATGGA ACAGCTGAATATGGGCCAAACAGGATATCTGTGGTAAGCAGTTCCTGCCCCGGCTCAGGGCCAAGAACAGA TGGTCCCCAGATGCGGTCCAGCCCTCAGCAGTTTCTAGAGAACCATCAGATGTTTCCAGGGTGCCCCAAGG ACCTGAAATGACCCTGTGCCTTATTTGAACTAACCAATCAGTTCGCTTCTCGCTTCTGTTCGCGCGCTTAT GCTCCCCGAGCTCAATAAAAGAGCCCACAACCCCTCACTCGGGGCGCCAGTCCTCCGATTGACTGAGTCGC CCGGGTACCCGTGTATCCAATAAACCCTCTTGCAGTTGCATCCGACTTGTGGTCTCGCTGTTCCTTGGGAG GGTCTCCTCTGAGTGATTGACTACCCGTCAGCGGGGGTCTTTCATTTGGGGGCTCGTCCGGGATCGGGAGA CCCCTGCCCAGGGACCACCGACCCACCACCGGGAGGTAAGCTGGCCAGCAACTTATCTGTGTCTGTCCGAT TGTCTAGTGTCTATGACTGATTTTATGCGCCTGCGTCGGTACTAGTTAGCTAA CTAGCTCTGTATCTGGCG GACCCGTGGTGAACTGACGAGTTCGGAACACCCGGCCGCAACCCTGGGAGACGTCCCAGGGACTTCGGGG GCCGTTTTTGTGGCCCGACCTGAGTCCTAAAATCCCGATCGTTTAGGACTCTTTGGTGCACCCCCCTTAGA GGAGGGATATGTGGTTCTGGTAGGAGACGAGAACCTAAAACAGTTCCCGCCTCCGTCTGAATTTTTGCTTT CGGTTTGGGACCGAAGCCGCGCCGCGCGTCTTGTCTGCTGCAGCATCGTTCTGTGTTGTCTCTGTCTGACT GTGTTTCTGTATTTGTCTGAAAATATGGGCCCGGGCTAGACTGTTACCACTCCCTTAAGTTTGACCTTAGG TCACTGGAAAGATGTCGAGCGGATCGCTCACAACCAGTCGGTAGATGTCAAGAAGAGACGTTGGGTTACCT TCTGCTCTGCAGAATGGCCAACCTTTAACGTCG GATGGCCGCGAGACGGCACCTTTAACCGAGACCTCATC ACCCAGGTTAAGATCAAGGTCTTTTCACCTGGCCCGCATGGACACCCAGACCAGGTCCCCTACATCGTGAC CTGGGAAGCCTTGGCTTTTGACCCCCTCCCTGGGTCAAGCCCTTTGTACACCCTAAGCCTCCGCCTCCTCTTCCTCCATCCGCCCCGTCTCTCCCCCTTGAACCTCCTCGTTCGACCCCGCCTCGATCCTCCCTTTATCCA GCCCTCACTCCTTCTCTAGGCGCCCCCATATGGCCATATGAGATCTTATATGGGGCACCCCCGCCCCTTGTAAACTTCCCTGACCCTGACATGACAAGAGTTACTAACAGCCCCTCTCTCCAAGCTCACTTACAGGCTCTCT ACTTAGTCCAGCACGAAGTCTGGAGACCTCTGGCGGCAGCCTACCAAGAACAACTGGACCGA [SEQ ID NO: 955]. The isolated nucleic acid molecule having the nucleotide sequence of SEQ ID NO:955 encodes a FcRL-5-targeted CAR (designated as 69 FcRL5-targeted BBz CAR) comprising a fully human scFv (encoded by nucleotides 207-1037 of SEQ ID NO:955) that comprises a heavy chain variable region comprising amino acids having the sequence set forth in SEQ ID NO:172, a light chain variable region comprising amino acids having the sequence set forth in SEQ ID NO:171, and a linker having an amino acid sequence of SEQ ID NO:307 positioned between the heavy chain variable region and the light chain variable region, a transmembrane domain comprising a CD8 polypeptide having 137 to 207 of SEQ ID NO: 960, and an intracellular domain comprising a CD3ζ polypeptide comprising amino acids 52 to 163 of SEQ ID NO: 941, and a co-stimulatory signaling region comprising a 4-1BB polypeptide having amino acids 214-255 of SEQ ID NO: 943. Nucleotides 207-1037 of SEQ ID NO: 955 encodes the human scFv. Nucleotides 1047-1259 of SEQ ID NO: 955 encodes the CD8 polypeptide comprised in the transmembrane domain. Nucleotides 1260-1385 of SEQ ID NO: 955 encodes the 4-1BB polypeptide comprised in the intracellular domain. Nucleotides 1386-1724 of SEQ ID NO: 955 encodes the CD3zeta polypeptide comprised in the intracellular domain. Other portions of SEQ ID NO: 955 are shown in Table 234.

TABLE 234

| Portions | Nucleotide Sequence Positions of SEQ ID NO: 955 | Number of Nucleotides |
| --- | --- | --- |
| anti-FcRL5 scFv 69 | 207 . . . 1037 | 831 |
| CD8a TM | 1047 . . . 1259 | 213 |
| 4-1BB | 1260 . . . 1385 | 126 |
| CD3zeta | 1386 . . . 1724 | 339 |
| LTR | 2004 . . . 2473 | 470 |
| M13 fwd | 3172 . . . 3188 | 17 |
| AmpR promoter | 3663 . . . 3767 | 105 |
| AmpR | 3768 . . . 4628 | 861 |
| ori | 4799 . . . 5387 | 589 |
| CAP binding site | 5675 . . . 5696 | 22 |
| lac promoter | 5711 . . . 5741 | 31 |
| lac operator | 5749 . . . 5765 | 17 |
| M13 rev | 5773 . . . 5789 | 17 |
| LTR | 6198 . . . 6791 | 594 |
| MMLV Psi | 6854 . . . 7211 | 358 |
| gag (truncated) | 7276 . . . 7692 | 417 |

In certain embodiments, the isolated nucleic acid molecule comprises nucleic acids having the sequence set forth in SEQ ID NO:956 provided below: CCGGTGGTACCTCACCCT-TACCGAGTCGGCGACACAGTGTGGGTCCGCCGACACCAGACTAAGAACCTAGA ACCTCGCTGGAAAGGACCTTACACAGTCCTGCTGACCACCCCCACCGCCCTCAAAGTAGACGGCATCGCAG CTTGGATACACGCCGCCCACGTGAAGGCTGCCGACCCCGGGGGTGGACCATCCTCTAGACTGCCATGGAAACCGACACCCTGCTGCTGTGGGTGCTGCTGCTGTGGGTGCCAGGATCCACAGGAAATTTTATGCTGACTCAG CCCCACTCTGTGTCGGAGTCTCCGGGGAAGACGGTAACCATCTCCTGCACCCGCAGCAGTGGCAGCATTGCCAGCAACTATGTGCAGTGGTACCAGCAGCGCCCGGGCAGTGCCCCCACCACTGTGATCTATGAGGATAACC AAAGACCCTCTGGGGTCCCTGATCGGTTCTCTGGCTCCATCGACAGCTCCTCCAACTCTGCCTCCCTCACCATCTCTGGACTGAAGACTGAGGACGAGGCTGACTACTACTGTCAGTCTTATGATAGCAGCAATGTGGTATT CGGCGGAGGGACCAAGGTCACCGTCCTAGGTTCTAGAGGTGGTGGTGGTAGCGGCGGCGGCGGCTCTGGTG GTGGTGGATCCCTCGAGATGGCCGAGGTGCAGCTGGTGGAGTCTGGGGGAGGCTTGGTACAGCCTGGAGGGTCCCTGAGACTCTCCTGTGCAGCCTCTGGATTCACCTTCAGTAGTTATGAAATGAACTGGGTCCGCCAGGC TCCAGGGAAGGGGCTGGAGTGGGTTTCATACATTAGTAGTAGTGGTAGTACCATATACTACGCAGACTCTGTGAAGGGCCGATTCACCATCTCCAGAGACAACGCCAAGAACTCACTGTATCTGCAAATGAACAGCCTGAGA GCCGAGGACACGGCTGTTTATTACTGTGCACGCTGGGACTACGGTATGGACGTCTGGGGCCAAGGGACCAC GGTCACCGTCTCCTCAGCGGCCGCACCCACCACGACGCCAGCGCCGCGACCACCAACCCCGGCCCCACGA TCGCGTCGCAGCCCCTGTCCCTGCGCCCAGAGGCGTGCCGGCCAGCGGCGGGGGGCGCAGTGCACACGAGG GGGCTGGACTTCGCCTGTGATATCTACATCTGGGCGCCCCTGGCCGGGACTTGTGGGGTCCTTCTCCTGTC ACTGGTTATCACCCTTTACTGCAACAAACGGGGCAGAAAGAAGCTCCTGTATATATTCAAACAACCATTTA TGAGACCAGTACAAACTACTCAAGAGGAAGATGGCTGTAGCTGCCGATTTCCAGAAGAAGAAGAAGGAGGA TGTGAACTGAGAGTGAAGTTCAGCAGGAGCGCAGAGCCCCCCGCGTACCAGCAGGGCCAGAACCAGCTCTA TAACGAGCTCAATCTAGGACGAAGAGAGGAGTACGATGTTTTGGACAAGAGACGTGGCCGGGACCCTGAGA TGGGGGGAAAGCCGAGAAGGAAGAACCCTCAGGAAGGCCTGTACAATGAACTGCAGAAAGATAAGATGGCG GAGGCCTACAGTGAGATTGGGATGAAAGGCGAGCGCCGGAGGGGCAAGGGGCACGATGGCCTTTACCAGGG TCTCAGTACAGCCACCAAGGACACCTACGACGCCCTTCACATGCAGGCCCTGCCCCCTCGCTAACAGCCAC TCGAGGATCCGGATTAGTCCAATTTGTTAAAGACAGGATATCAGTGGTCCAGGCTCTAGTTTTGACTCAAC AATATCACCAGCTGAAGCCTATAGAGTACGAGCCATAGATAAAATAAAAGATTTTATTTAGTCTCCAGAAA AAGGGGGGAATGAAAGACCCCACCTGTAGGTTTGGCAAGCTAGCTTAAGTAACGCCATTTTGCAAGGCATG GAAAAATACATAACTGAGAATAGAGAAGTTCAGAT- CAAGGTCAGGAACAGATGGAACAGCTGAATATGGGC CAAACAGGATATCTGTGGTAAGCAGTTCCTGCCCCGGCTCAGGGCCAAGAACAGATGGAACAGCTGAATAT GGGCCAAACAGGATATCTGTGGTAAGCAGTTCCTGCCCCGGCTCAGGGCCAAGAACAGATGGTCCCCAGATGCGGTCCAGCCCTCAGCAGTTTCTAGAGAACCATCAGATGTTTCCAGGGTGCCCCAAGGACCTGAAATGAC CCTGTGCCTTATTTGAACTAACCAATCAGTTCGCTTCTCGCTTCTGTTCGCGCTTCTGCTCCCCGAGCT CAATAAAAGAGCCCACAACCCCTCACTCGGGGCGCCAGTCCTCCGATTGACTGAGTCGCCCGGGTACCCGT GTATCCAATAAACCCTCTTGCAGTTGCATCCGACTTGTGGTCTCGCTGTTCCTTGGGAGGGTCTCCTCTGAGTGATTGACTACCCGTCAGCGGGGTCTTTCACACATGCAGCATGTATCAAAATTAATTTGGTTTTTTTCTTAAGTATTTACATTAAATGGCCATAGTACTTAAAGTTACATTGGCTTCCTTGAAATAAACATGGAGTATT CAGAATGTGTCATAAATATTTCTAATTTTAAGATAGTATCTCCATTGGCTTTCTACTTTTTCTTTTATTTT TTTTTGTCCTCTGTCTTCCATTTGTTGTTGTTGTTGTTTGTTTGTTTGTTGGTTGGTTAATTT TTTTTTAAAGATCCTACACTATAGTTCAAGCTAGACTATTAGCTACTCTGTAACCCAGGGTGACCTTGAAGTCATGGGTAGCCTGCTGTTTTAGCCTTCCCACATCTAAGATTACAGGTATGAGCTATCATTTTTGGTATAT TGATTGATTGATTGATTGATGTGTGTGTGTGATTGTGTTTGTGTGTGTGACTGTGAAAATGTGTGTATG GGTGTGTGTGAATGTGTGTATGTATGTGTGTGTGAGTGTGTGTGTGTGTGTGCATGTGTGTGTGT GACTGTGTCTATGTGTATGACTGTGTGTGTGTGTGTGTGTGTGTGTGTGTGTGTGTGTGTGTTGT GAAAAAATATTCTATGGTAGTGAGAGCCAACGCTCCGGCTCAGGTGTCAGGTTGGTTTTTGAGACAGAGTC TTTCACTTAGCTTGGAATTCACTGGCCGTCGTTTTACAACGTCGTGACTGGGAAAACCCTGGCGTTACCCAACTTAATCGCCTTGCAGCACATCCCCCTTTCGCCAGCTGGCGTAATAGCGAAGAGGCCCGCACCGATCGCC CTTCCCAACAGTTGCGCAGCCTGAATGGCGAATGGCGCCTGATGCGGTATTTTCTCCTTACGCATCTGTGCGGTATTTCACACCGCATATGGTGCACTCTCAGTACAATCTGCTCTGATGCCGCATAGTTAAGCCAGCCCCG ACACCCGCCAACACCCGCTGACGCGCCCTGACGGGCTTGTCTGCTCCCGGCATCCGCTTACAGACAAGCTGTGACCGTCTCCGGGAGCTGCATGTGTCAGAGGTTTTCACCGTCATCACCGAAACGCGCGATGACGAAAGGG CCTCGTGATACGCCTATTTTTATAGGTTAATGTCATGATAATAATGGTTTCTTAGACGTCAGGTGGCACTT TTCGGGGAAATGTGCGCGGAACCCCTATTTGTTTATTTTTCTAAATACATTCAAATATGTATCCGCTCATGAGACAATAACCCTGATAAATGCTTCAATAATATTGAAAAAGGAAGAGTATGAGTATTCAACATTTCCGTGT CGCCCTTATTCCCTTTTTTGCGGCATTTTGCCTTCCTGTTTTTGCTCACCCAGAAACGCTGGTGAAAGTAA AAGATGCTGAAGATCAGTTGGGTGCACGAGTGGGTTACATCGAACTGGATCTCAACAGCGGTAAGATCCTT GAGAGTTTTCGCCCCGAAGAACGTTTTCCAATGATGAGCACTTTTAAAGTTCTGCTATGTGGCGCGGTATTATCCCGTATTGACGCCGGGCAAGAGCAACTCGGTCGCCGCATACACTATTCTCAGAATGACTTGGTTGAGT ACTCACCAGTCACAGAAAAGCATCTTACGGATGGCATGACAGTAAGAGAATTATGCAGTGCTGCCATAACCATGAGTGATAACACTGCGGCCAACTTACTTCTGACAACGATCGGAGGACCGAAGGAGCTAACCGCTTTTTT GCACAACATGGGGGATCATGTAACTCGCCTTGATCGTTGGGAACCGGAGCTGAATGAAGCCATACCAAACGACGAGCGTGACACCACGATGCCTGTAGCAATGGCAACAACGTTGCGCAAACTATTAACTGGCGAACTACTT ACTCTAGCTTCCCGGCAACAATTAATAGACTGGATGGAGGCGGATAAAGTTGCAGGACCACTTCTGCGCTC GGCCCTTCCGGCTGGCTGGTTTATTGCTGATAAATCTGGAGCCGGTGAGCGTGGGTCTCGCGGTATCATTG CAGCACTGGGGCCAGATGGTAAGCCCTCCCGTATCGTAGTTATCTACACGACGGGGAGTCAGGCAACTATG GATGAACGAAATAGACAGATCGCTGAGATAGGTGCCTCACTGATTAAGCATTGGTAACTGTCAGACCAAGTTTACTCATATATACTTTAGATTGATTTAAAACTTCATTTTTAATTTAAAAGGATCTAGGTGAAGATCCTTTTTGATAATCTCATGACCAAAATCCCTTAACGTGAGTTTTCGTTCCACTGAGCGTCAGACCCCGTAGAAAAG ATCAAAGGATCTTCTTGAGATCCTTTTTTTCTGCGCGTAATCTGCTGCTTGCAAACAAAAAAACCACCGCTACCAGCGGTGGTTTGTTTGCCGGATCAAGAGCTACCAACTCTTTTTCCGAAGGTAACTGGCTTCAGCAG AG CGCAGATACCAAATACTGTCCTTCTAGTGTAGCCGTAGTTAGGCCACCACTTCAAGAACTCTGTAGCACCG CCTACATACCTCGCTCTGCTAATCCTGTTACCAGTGGCTGCTGCCAGTGGCGATAAGTCGTGTCTTACCGG GTTGGACTCAAGACGATAGTTACCGGATAAGGCGCAGCGGTCGGGCTGAACGGGGGGTTCGTGCACACAGC CCAGCTTGGAGCGAACGACCTACACCGAACTGAGATACCTACAGCGTGAGCATTGAGAAAGCGCCACGCTT CCCGAAGGGAGAAAGGCGGACAGGTATCCGGTAAGCGGCAGGGTCGGAACAGGAGAGCGCACGAGGGAGCTTCCAGGGGGAAACGCCTGGTATCTTTATAGTCCTGTCGGGTTTCGCCACCTCTGACTTGAGCGTCGATTTT TGTGATGCTCGTCAGGGGGCGGAGCCTATGGAAAAACGCCAGCAACGCGGCCTTTTTACGGTTCCTGGCCTTTTGCTGGCCTTTTGCTCACATGTTCTTTCCTGCGTTATCCCTGATTCTGTGGATAACCGTATTACCGC CTTTGAGTGAGCTGATACCGCTCGCCGCAGCCGAACGACCGAGCGCAGCGAGTCAGTGAGCGAGGAAGCGG AAGAGCGCCCAATACGCAAACCGCCTCTCCCCGCGCGTTGGCCGATTCATTAATGCAGCTGGCACGACAGG TTTCCCGACTGGAAAGCGGGCAGTGAGCGCAACGCAATTAATGTGAGTTAGCTCACTCATTAGGCACCCCA GGCTTTACACTTTATGCTTCCGGCTCGTATGTTGTGTGGAATTGTGAGCGGATAACAATTTCACACAGGAA ACAGCTATGACCATGATTACGCCAAGCTTTGCTCTTAGGAGTTTCCTAATACATCCCAAACTCAAATATAT AAAGCATTTGACTTGTTC TATGCCCTAGGGGGCGGGGG-
GAAGCTAAGCCAGCTTTTTTTAACATTTAAAAT
GTTAATTCCATTTTAAATGCACAGATGTTTTTATTT-
CATAAGGGTTTCAATGTGCATGAATGCTGCAATAT
TCCTGTTACCAAAGCTAGTATAAATAAAAATAGA-
TAAACGTGGAAATTACTTAGAGTTTCTGTCAT-
TAACG TTTCCTTCCTCAGTTGACAACAT-
AAATGCGCTGCTGAGCAAGCCAGTTTGCATCTGTC
AGGATCAATTTCC CATTATGCCAGTCATATTAAT-
TACTAGTCAATTAGTTGATTTTTATTTTTGACATATA-
CATGTGAATGAAA GACCC-
CACCTGTAGGTTTGGCAAGCTAGCTTAAGTAACG
CCATTTTGCAAGGCATGGAAAAATACATAACT
GAGAATAGAAAAGTTCAGATCAAGGTCAGGAACA-
GATGGAACAGCTGAATATGGGCCAAACAGGA-
TATCTG
TGGTAAGCAGTTCCTGCCCCGGCTCAGGGC-
CAAGAACAGATGGAACAGCTGAATATGGGC-
CAAACAGGATA
TCTGTGGTAAGCAGTTCCTGCCCCGGCTCAGGGC-
CAAGAACAGATGGTCCCCA-
GATGCGGTCCAGCCCTCA GCAGTTTCTAGAGAAC-
CATCAGATGTTTCCAGGGTGCCCCAAGGACCTGA
AATGACCCTGTGCCTTATTTG AACTAAC-
CAATCAGTTCGCTTCTCGCTTCTGTTCGCGCGCT-
TATGCTCCCCGAGCTCAATAAAAGAGCCCA
CAACCCCTCACTCGGGGCGCCAGTCCTCCGAT-
TGACTGAGTCGCCCGGGTACCCGTGTATC-
CAATAAACCC TCTTGCAGTTG-
CATCCGACTTGTGGTCTCGCTGTTCCTTGGGAGGG
TCTCCTCTGAGTGATTGACTACCCG
TCAGCGGGGGTCTTTCATTTGGGGGCTCGTCCGG-
GATCGGGAGACCCCTGCCCAGGGACCACCGACC-
CACC ACCGGGAGGTAAGCTGGCCAGCAACT-
TATCTGTGTCTGTCCGATTGTCTAGTGTCTATGACT
GATTTTATG CGCCTGCGTCGGTACTAGT-
TAGCTAACTAGCTCTGTATCTGGCGGACCCGTGGT
GGAACTGACGAGTTCGG
AACACCCGGCCGCAACCCTGGGA-
GACGTCCCAGGGACTTCGGGGGCCGTTTTTGTGG
CCCGACCTGAGTCC TAAAATCCCGATCGTT-
TAGGACTCTTTGGTGCACCCCCCTTAGAGGAGG-
GATATGTGGTTCTGGTAGGAGA
CGAGAACCTAAAACAGTTCCCGCCTCCGTCTGAAT-
TTTTGCTTTCGGTTTGGGACCGAAGCCGCGCCGC
GC GTCTTGTCTGCTGCAG-
CATCGTTCTGTGTTGTCTCTGTCTGACTGTGTTTC
TGTATTTGTCTGAAAATATG GGCCCGGGCTA-
GACTGTTACCACTCCCTTAAGTTTGACCTTAGGT-
CACTGGAAAGATGTCGAGCGGATCGC
TCACAACCAGTCGGTAGATGTCAAGAAGA-
GACGTTGGGTTACCTTCTGCTCTGCAGAATGGC-
CAACCTTTA ACGTCGGATGGCCGCGA-
GACGGCACCTTTAACCGAGACCTCATCACCCAGG
TTAAGATCAAGGTCTTTTCA CCTGGCCCG-
CATGGACACCCAGACCAGGTCCCCTA-
CATCGTGACCTGG-
GAAGCCTTGGCTTTTGACCCCCC
TCCCTGGGTCAAGCCCTTTGTA-
CACCCTAAGCCTCCGCCTCCTCTTCCTC-
CATCCGCCCCGTCTCTCCCCC
TTGAACCTCCTCGTTCGACCCCGCCTC-
GATCCTCCCTTTATCCAGCCCT-
CACTCCTTCTCTAGGCGCCCCC ATATGGCCATAT-
GAGATCTTATATGGGGCACCCCCGCCCCTTGTAAA
CTTCCCTGACCCTGACATGACAAG
AGTTACTAACAGCCCCTCTCTCCAAGCTCACTTA-
CAGGCTCTCTACTTAGTCCAGCACGAAGTCTGGA-
GAC CTCTGGCGGCAGCCTAC-
CAAGAACAACTGGACCGA [SEQ ID NO: 956]. The isolated nucleic acid molecule having the nucleotide sequence of SEQ ID NO:956 encodes a FcRL-5-targeted CAR (designated as 104 FcRL5-targeted BBz CAR) comprising a fully human scFv (encoded by nucleotides 207-1010) that comprises a heavy chain variable region comprising amino acids having the sequence set forth in SEQ ID NO:216, a light chain variable region comprising amino acids having the sequence set forth in SEQ ID NO:215, and a linker having an amino acid sequence of SEQ ID NO:307 positioned between the heavy chain variable region and the light chain variable region, a transmembrane domain comprising a CD8 polypeptide having 137 to 207 of SEQ ID NO: 960, and an intracellular domain comprising a CD3ζ polypeptide comprising amino acids 52 to 163 of SEQ ID NO: 941, and a co-stimulatory signaling region comprising a 4-1BB polypeptide having amino acids 214-255 of SEQ ID NO: 943. Nucleotides 207-1010 of SEQ ID NO: 956 encodes the human scFv. Nucleotides 1020-1232 of SEQ ID NO: 956 encodes the CD8 polypeptide comprised in the transmembrane domain. Nucleotides 1233-1358 of SEQ ID NO: 956 encodes the 4-1BB polypeptide comprised in the intracellular domain. Nucleotides 1359-1697 of SEQ ID NO: 956 encodes the CD3zeta polypeptide comprised in the intracellular domain. Other portions of SEQ ID NO: 956 are shown in Table 235.

TABLE 235

| Portions | Nucleotide Sequence Positions of SEQ ID NO: 956 | Number of Nucleotides |
| --- | --- | --- |
| antiFcRL5 scFv 104 | 207 ... 1010 | 804 |
| CD8a TM | 1020 ... 1232 | 213 |
| 4-1BB | 1233 ... 1358 | 126 |
| CD3zeta | 1359 ... 1697 | 339 |
| LTR | 1977 ... 2446 | 470 |
| M13 fwd | 3145 ... 3161 | 17 |
| AmpR promoter | 3636 ... 3740 | 105 |
| AmpR | 3741 ... 4601 | 861 |
| ori | 4772 ... 5360 | 589 |
| CAP binding site | 5648 ... 5669 | 22 |
| lac promoter | 5684 ... 5714 | 31 |
| lac operator | 5722 ... 5738 | 17 |
| M13 rev | 5746 ... 5762 | 17 |
| LTR | 6171 ... 6764 | 594 |
| MMLV Psi | 6827 ... 7184 | 358 |
| gag (truncated) | 7249 ... 7665 | 417 |

In certain embodiments, the isolated nucleic acid molecule comprises nucleic acids having the sequence set forth in SEQ ID NO:957 provided below: CCGGTGGTACCT-
CACCCT-
TACCGAGTCGGCGACACAGTGTGGGTCCGCCGAC
ACCAGACTAAGAACCTAGA ACCTCGCTG-
GAAAGGACCTTACACAGTCCTGCTGACCACCC-
CACCGCCCTCAAAGTAGACGGCATCGCAG CTTG-
GATACACGCCGCCCACGTGAAGGCTGCCGACCCC
GGGGGTGGACCATCCTCTAGACTGCCATGGAAA
CCGATA-
CACTGCTGCTGTGGGTGCTGCTGCTGTGGGTGCCA
GGATCCACAGGCTCCTATGTGCTGACTCAG
CCACCCTCAGTGTCCGTGTCCCAGGACA-
GACAGCCAGCATCACCTGCTCTGGAGATAGAT-
TGACGAATAA ATATGTTTCCTGGTAT- CAACAGAAGCCAGGCCAGTCCCCTGTGTTGGTCATCTATGAGGATGCCAAGCGGC CCTCAGGGATCCCTGCGCGATTCTCTGGCTCCAACTCTGGGAACACAGCCACTCTGACCATCAGCGGGACCCAGGCTATGGATGAGTCTGAATATTACTGTCAGGCGTGGGACAGCAGTGTGGTGGTTTTTGGCGGAGGGACCAAGCTGACCGTCCTAGGTTCTAGAGGTGGTGGTGGTAGCGGCGGCGGCGGCTCTGGTGGTGGTGATCCC TCGAGATGGCCGAGGTGCAGCTGGTGGAGTCTGGGGGAGGCTTGGTACAGCCTGGCAGGTCCCTGAGACTCTCCTGTGCAGCCTCTGGATTTACCTTTGATGATTATGCCATGCACTGGGTCCGGCAAGCTCCAGGGAAGGG CCTGGAGTGGGTCTCAGGTATTAGTTGGAATAGTGGTAGTATAGGCTATGCGGACTCTGTGAAGGGCCGAT TCACCATCTCCAGAGACAACGCAAGAACTCCCTGTATCTGCAAATGAACAGTCTGAGAGATGAGGACACG GCCTTGTATTACTGTGCAAAAGACCGAGGGGGGGAGTTATCGTTAAGGATGCTTTTGATATCTGGGGCCAAGGGACAATGGTCACCGTCTCTTCAGCGGCCGCACCCACCACGACGCCAGCGCCGCGACCACCAACCCCGGCGCCCACGATCGCGTCGCAGCCCCTGTCCCTGCGCCCAGAGGCGTGCCGGCCAGCGGCGGGGGGCGCAGTGCACACGAGGGGGCTGGACTTCGCCTGTGATATCTACATCTGGGCGCCCCTGGCCGGGACTTGTGGGGTCCT TCTCCTGTCACTGGTTATCACCCTTTACTGCAACAAACGGGGCAGAAAGAAGCTCCTGTATATATTCAAAC AACCATTTATGAGACCAGTACAAACTACTCAAGAGGAAGATGGCTGTAGCTGCCGATTTCCAGAAGAAGAA GAAGGAGGATGTGAACTGAGAGTGAAGTTCAGCAGGAGCGCAGAGCCCCCCGCGTACCAGCAGGGCCAGAA CCAGCTCTATAACGAGCTCAATCTAGGACGAAGAGAGGAGTACGATGTTTTGGACAAGAGACGTGGCCGGGACCCTGAGATGGGGGGAAAGCCGAGAAGGAAGAACCCTCAGGAAGGCCTGTACAATGAACTGCAGAAAGATAAGATGGCGGAGGCCTACAGTGAGATTGGGATGAAAGGCGAGCGCCGGAGGGGCAAGGGGCACGATGGCCT TTACCAGGGTCTCAGTACAGCCACCAAGGACACCTACGACGCCCTTCACATGCAGGCCCTGCCCCCTCGCT AACAGCCACTCGAGGATCCGGATTAGTCCAATTTGTTAAAGACAGGATATCAGTGGTCCAGGCTCTAGTTT TGACTCAACAATATCACCAGCTGAAGCCTATAGAGTACGAGCCATAGATAAAATAAAAGATTTTATTTAGTCTCCAGAAAAAGGGGGAATGAAAGACCCCACCTGTAGGTTTGGCAAGCTAGCTTAAGTAACGCCATTTTG CAAGGCATGGAAAAATACATAACTGAGAATAGAGAAGTTCAGATCAAGGTCAGGAACAGATGGAACAGCTG AATATGGGCCAAACAGGATATCTGTGGTAAGCAGTTCCTGCCCCGGCTCAGGGCCAAGAACAGATGGAACA GCTGAATATGGGCCAAACAGGATATCTGTGGTAAGCAGTTCCTGCCCCGGCTCAGGGCCAAGAACAGATGG TCCCCAGATGCGGTCCAGCCCTCAGCAGTTTCTAGAGAACCATCAGATGTTTCCAGGGTGCCCCAAGGACCTGAAATGACCCTGTGCCTTATTTGAACTAACCAATCAGTTCGCTTCTCGCTTCTGTTCGCGCGCTTCTGCT CCCCGAGCTCAATAAAAGAGCCCACAACCCCTCACTCGGGGCGCCAGTCCTCCGATTGACTGAGTCGCCCG GGTACCCGTGTATC CAATAAACCCTCTTGCAGTTGCATCCGACTTGTGGTCTCGCTGTTCCTTGGGAGGGT CTCCTCTGAGTGATTGACTACCCGTCAGCGGGGGTCTTTCACACATGCAGCATGTATCAAAATTAATTTGG TTTTTTTTCTTAAGTATTTACATTAAATGGCCATAGTACTTAAAGTTACATTGGCTTCCTTGAAATAAACA TGGAGTATTCAGAATGTGTCATAAATATTTCTAATTTTAAGATAGTATCTCCATTGGCTTTCTACTTTTTC TTTTATTTTTTTTTGTCCTCTGTCTTCCATTTGTTGTTGTTGTTGTTTGTTTGTTTGTTGGT TGGTT GGTTAATTTTTTTTTAAAGATCCTACACTATAGTTCAAGCTAGACTATTAGCTACTCTGTAACCCAGGGTG ACCTTGAAGTCATGGGTAGCCTGCTGTTTTAGCCTTCCCACATCTAAGATTACAGGTATGAGCTATCATTT TTGGTATATTGATTGATTGATTGATTGATGTGTGTGTGTGTGATTGTGTTTGTGTGTGTGACTGTGAAAAT GTGTGTATGGGTGTGTGTGAATGTGTGTATGTATGTGTGTGTGTGAGTGTGTGTGTGTGTGTGCATGTG TGTGTGTGTGACTGTGTCTATGTGTATGACTGTGTGTGTGTGTGTGTGTGT GTGTGTGTGTGTGTGT GTGTGTTGTGAAAAAATATTCTATGGTAGTGAGAGCCAACGCTCCGGCTCAGGTGTCAGGTTGGTTTTTGA GACAGAGTCTTTCACTTAGCTTGGAATTCACTGGCCGTCGTTTTACAACGTCGTGACTGGGAAAACCCTGG CGTTACCCAACTTAATCGCCTTGCAGCACATCCCCCTTTCGCCAGCTGGCGTAATAGCGAAGAGGCCCGCA CCGATCGCCCTTCCCAACAGTTGCGCAGCCTGAATGGCGAATGGCGCCTGATGCGGTATTTTCTCCTTACG CATCTGTGCGGTATTTCACACCGCATATGGTGCACTCTCAGTACAATCTGCTCTGATGCCGCATAGTTAAG CCAGCCCCGACACCCGCCAACACCCGCTGACGCGCCCTGACGGGCTTGTCTGCTCCCGGCATCCGCTTACA GACAAGCTGTGACCGTCTCCGGGAGCTGCATGTGTCAGAGGTTTTCACCGTCATCACCGAAACGCGCGATG ACGAAAGGGCCTCGTGATACGCCTATTTTTATAGGTTAATGTCATGATAATAATGGTTTCTTAGACGTCAG GTGGCACTTTTCGGGGAAATGTGCGCGGAACCCCTATTTGTTTATTTTTCTAAATACATTCAAATATGTAT CCGCTCATGAGACAATAACCCTGATAAATGCTTCAATAATATTGAAAAAGGAAGAGTATGAGTATTCAACA TTTCCGTGTCGCCCTTATTCCCTTTTTTGCGGCATTTTGCCTTCCTGTTTTTGCTCACCCAGAAACGCTGG TGAAAGTAAAAGATGCTGAAGATCAGTTGGGTGCACGAGTGGGTTACATCGAACTGGATCTCAACAGCGGT AAGATCCTTGAGAGTTTTCGCCCCGAAGAACGTTTTCCAATGATGAGCACTTTTAAAGTTCTGCTATGTGG CGCGGTATTATCCCGTATTGACGCCGGGCAAGAGCAACTCGGTCGCCGCATACACTATTCTCAGAATGACT TGGTTGAGTACTCACCAGTCACAGAAAAGCATCTTACGGATGGCATGACAGTAAGAGAATTATGCAGTGCT GCCATAACCATGAGTGATAACACTGCGGCCAACTTACTTCTGACAACGATCGGAGGACCGAAGGAGCTAAC CGCTTTTTTGCACAACATGGGGGATCATGTAACTCGCCTTGATCGTTGGGAACCGGAGCTGAATGAAGCCA TACCAAACGACGAGCGTGACACCACGATGCCTGTAGCAATGGCAACAACGTTGCGCAAACTATTAACTGGC GAACTACT TACTCTAGCTTCCCGGCAACAATTAATAGACTGGATGGAGGCGGATAAAGTTGCAGGACCACTTCTGCGCTCGGCCCTTCCGGCTGGCTGGTTTATTGCTGATAAATCTGGAGCCGGTGAGCGTGGGTCTCGCG GTATCATTGCAGCACTGGGGCCAGATGGTAAGCCCTCCCGTATCGTAGTTATCTACACGACGGGGAGTCAGGCAACTATGGATGAACGAAATAGACAGATCGCTGAGATAGGTGCCTCACTGATTAAGCATTGGTAACTGTC AGACCAAGTTTACTCATATATACTTTAGATTGATTTAAAACTTCATTTTAATTTAAAAGGATCTAGGTGA AGATCCTTTTTGATAATCTCATGACCAAAATCCCTTAACGTGAGTTTTCGTTCCACTGAGCGTCAGACCCC GTAGAAAAGATCAAAGGATCTTCTTGAGATCCTTTTTTTCTGCGCGTAATCTGCTGCTTGCAAACAAAAAA ACCACCGCTACCAGCGGTGGTTTGTTTGCCGGATCAAGAGCTACCAACTCTTTTTCCGAAGGTAACTGGCTTCAGCAGAGCGCAGATACCAAATACTGTCCTTCTAGTGTAGCCGTAGTTAGGCCACCACTTCAAGAACTCT GTAGCACCGCCTACATACCTCGCTCTGCTAATCCTGTTACCAGTGGCTGCTGCCAGTGGCGATAAGTCGTG TCTTACCGGGTTGGACTCAAGACGATAGTTACCGGATAAGGCGCAGCGGTCGGGCTGAACGGGGGGTTCGTGCACACGCCCAGCTTGGAGCGAACGACCTACACCGAACTGAGATACCTACAGCGTGAGCATTGAGAAAGC GCCACGCTTCCCGAAGGGAGAAAGGCGGACAGGTATCCGGTAAGCGGCAGGGTCGGAACAGGAGAGCGCAC GAGGGAGCTTCCAGGGGGAAACGCCTGGTATCTTTATAGTCCTGTCGGGTTTCGCCACCTCTGACTTGAGCGTCGATTTTTGTGATGCTCGTCAGGGGGGCGGAGCCTATGGAAAAACGCCAGCAACGCGGCCTTTTTACGGTTCCTGGCCTTTTGCTGGCCTTTTGCTCACATGTTCTTTCCTGCGTTATCCCCTGATTCTGTGGATAACCG TATTACCGCCTTTGAGTGAGCTGATACCGCTCGCCGCAGCCGAACGACCGAGCGCAGCGAGTCAGTGAGCG AGGAAGCGGAAGAGCGCCCAATACGCAAACCGCCTCTCCCCGCGCGTTGGCCGATTCATTAATGCAGCTGGCACGACAGGTTTCCCGACTGGAAAGCGGGCAGTGAGCGCAACGCAATTAATGTGAGTTAGCTCACTCATTA GGCACCCCAGGCTTTACACTTTATGCTTCCGGCTCGTATGTTGTGTGGAATTGTGAGCGGATAACAATTTC ACACAGGAAACAGCTATGACCATGATTACGCCAAGCTTTGCTCTTAGGAGTTTCCTAATACATCCCAAACTCAAATATATAAAGCATTTGACTTGTTCTATGCCCTAGGGGGCGGGGGGAAGCTAAGCCAGCTTTTTTTAAC ATTTAAAATGTTAATTCCATTTTAAATGCACAGATGTTTTTATTTCATAAGGGTTTCAATGTGCATGAATG CTGCAATATTCCTGTTACCAAAGCTAGTATAAATAAAAATAGATAAACGTGGAAATTACTTAGAGTTTCTG TCATTAACGTTTCCTTCCTCAGTTGACAACATAAATGCGCTGCTGAGCAAGCCAGTTTGCATCTGTCAGGATCAATTTCCCATTATGCCAGTCATATTAATTACTAGTCAATTAGTTGATTTTTATTTTTGACATATACATGTGAATGAAAGACCCCACCTGTAGGTTTGGCAAGCTAGCTTAAGTAACGCCATTTTGCAAGGCATGGAAAAA TACATAACTGAGAATAGAAAAGTTCAGATCAAGGTCAGGAACAGATGGAACAGCTGAATATGGGCCAAACA GGATATCTGTGGTAAGCAGTTCCTGCCCCGGCTCAGGGCCAAGAACAGATGGAACAGCTGAATATGGGCCAAACAGGATATCTGTGGTAAGCAGTTCCTGCCCCGGCTCAGGGCCAAGAACAGATGGTCCCCAGATGCGGTCCAGCCCTCAGCAGTTTCTAGAGAACCATCAGATGTTTCCAGGGTGCCCCAAGGACCTGAAATGACCCTGTG CCTTATTTGAACTAACCAATCAGTTCGCTTCTCGCTTCTGTTCGCGCTTATGCTCCCCGAGCTCAATAA AAGAGCCCACAACCCCTCACTCGGGGCGCCAGTCCTCCGATTGACTGAGTCGCCCGGGTACCCGTGTATCCAATAAACCCTCTTGCAGTTGCATCCGACTTGTGGTCTCGCTGTTCCTTGGGAGGGTCTCCTCTGAGTGATT GACTACCCGTCAGCGGGGGTCTTTCATTTGGGGGCTCGTCCGGGATCGGGAGACCCCTGCCCAGGGACCACCGACCCACCACCGGGAGGTAAGCTGGCCAGCAACTTATCTGTGTCTGTCCGATTGTCTAGTGTCTATGACTGATTTTATGCGCCTGCGTCGGTACTAGTTAGCTAACTAGCTCTGTATCTGGCGGACCCGTGGTGGAACTGA CGAGTTCGAACACCCGGCCGCAACCCTGGGAGACGTCCCAGGGACTTCGGGGGCCGTTTTGTGGCCCGA CCTGAGTCCTAAAATCCCGATCGTTTAGGACTCTTTGGTGCACCCCCCTTAGAGGAGGGATATGTGGTTCT GGTAGGAGACGAGAACCTAAAACAGTTCCCGCCTCCGTCTGAATTTTTGCTTTCGGTTTGGGACCGAAGCCGCGCCGCGCGTCTTGTCTGCTGCAGCATCGTTCTGTGTTGTCTCTGTCTGACTGTGTTTCTGTATTTGTCT GAAAATATGGGCCCGGGCTAGACTGTTACCACTCCCTTAAGTTTGACCTTAGGTCACTGGAAAGATGTCGA GCGGATCGCTCACAACCAGTCGGTAGATGTCAAGAAGAGACGTTGGGTTACCTTCTGCTCTGCAGAATGGC CAACCTTTAACGTCGGATGGCCGCGAGACGGCACCTTTAACCGAGACCTCATCACCCAGGTTAAGATCAAG GTCTTTTCACCTGGCCCGCATGGACACCCAGACCAGGTCCCCTACATCGTGACCTGGGAAGCCTTGGCTTT TGACCCCCCTCCCTGGGTCAAGCCCTTTGTACACCCTAAGCCTCCGCCTCCTCTTCCTCCATCCGCCCCGT CTCTCCCCCTTGAACCTCCTCGTTCGACCCCGCCTCGATCCTCCCTTTATCCAGCCCTCACTCCTTCTCTAGGCGCCCCCATATGGCCATATGAGATCTTATATGGGGCACCCCCGCCCCTTGTAAACTTCCCTGACCCTGA CATGACAAGAGTTACTAACAGCCCTCTCTCCAAGCTCACTTACAGGCTCTCTACTTAGTCCAGCACGAAG TCTGGAGACCTCTGGCGGCAGCCTACCAAGAACAACTGGACCGA [SEQ ID NO: 957]. The isolated nucleic acid molecule having the nucleotide sequence of SEQ ID NO:957 encodes a FcRL-5-targeted CAR (designated as 105 FcRL5-targeted BBz CAR) comprising a fully human scFv (encoded by nucleotides 207-1019) that comprises a heavy chain variable region comprising amino acids having the sequence set forth in SEQ ID NO:220, a light chain variable region comprising amino acids having the sequence set forth in SEQ ID NO:219, and a linker having an amino acid sequence of SEQ ID NO:307 positioned between the heavy chain variable region and the light chain variable region, a transmembrane domain comprising a CD8 polypeptide having 137 to 207 of SEQ ID NO: 960, and an intracellular domain comprising a CD3ζ polypeptide comprising amino acids 52 to 163 of SEQ ID NO: 941, and a co-stimulatory signaling region comprising a 4-1BB polypeptide having amino acids 214-255 of SEQ ID NO: 943. Nucleotides 207-1019 of SEQ ID NO: 957 encodes the human scFv. Nucleotides 1029-1241 of SEQ ID NO: 957 encodes the CD8 polypeptide comprised in the transmembrane domain. Nucleotides 1242-1367 of SEQ ID NO: 957 encodes the 4-1BB polypeptide comprised in the intracellular domain. Nucleotides 1368-1706 of SEQ ID NO: 957 encodes the CD3zeta polypeptide comprised in the intracellular domain. Other portions of SEQ ID NO: 957 are shown in Table 236.

TABLE 236

| Portions | Nucleotide Sequence Positions of SEQ ID NO: 957 | Number of Nucleotides |
|---|---|---|
| antiFcRL5 scFv 105 | 207 . . . 1019 | 813 |
| CD8a TM | 1029 . . . 1241 | 213 |
| 4-1BB | 1242 . . . 1367 | 126 |
| CD3zeta | 1368 . . . 1706 | 339 |
| LTR | 1986 . . . 2455 | 470 |
| M13 fwd | 3154 . . . 3170 | 17 |
| AmpR promoter | 3645 . . . 3749 | 105 |
| AmpR | 3750 . . . 4610 | 861 |
| ori | 4781 . . . 5369 | 589 |
| CAP binding site | 5657 . . . 5678 | 22 |
| lac promoter | 5693 . . . 5723 | 31 |
| lac operator | 5731 . . . 5747 | 17 |
| M13 rev | 5755 . . . 5771 | 17 |
| LTR | 6180 . . . 6773 | 594 |
| MMLV Psi | 6836 . . . 7193 | 358 |
| gag (truncated) | 7258 . . . 7674 | 417 |

In certain embodiments, the isolated nucleic acid molecule comprises nucleic acids having the sequence set forth in SEQ ID NO:958 provided below: CCGGTGGTACCTCACCCTTACCGAGTCGGCGACACAGTGTGGGTCCGCCGACACCAGACTAAGAACCTAGA ACCTCGCTGGAAAGGACCTTACACAGTCCTGCTGACCACCCCCACCGCCCTCAAAGTAGACGGCATCGCAG CTTGGATACACGCCGCCCACGTGAAGGCTGCCGACCCCGGGGGTGGACCATCCTCTAGACTGCCATGGAAACCGACACCCTGCTGCTGTGGGTGCTGCTGCTGTGGGTGCCAGGATC-CACAGGACTGCCTGTGCTGACTCAGCCACCCTCAGCGTCTGCGACCCCCGGGCAGAGGGTCACCATCTCTTGTTCTGGAACCACCTCCAACATCGGAAGTAATACTGTACACTGGTACCAGCAGCTCCCAGGGACGGCCCCCAAACTCCTCATCTATAATAATAATCAGCGGCCCTCAGGGGTCCCTGACCGATCTCTGGCTCCAAGTCTGGCACCTCAGCCTCCCTGGCCATCAGTGGGCTCCGGTCCGAGGATGAGGCTACATATTCCTGTGCAACATGGGATGACAGCCTGAGTGGTGTGGTCTT CGGCGGAGGGACCAAGCTGACCGTCCTAGGTTCTAGAGGTGGTGGTGGTAGCGGCGGCGGCGGCTCTGGTG GTGGTGGATCCCTCGAGATGGCCGAGGTCCAGCTGGTGCAGTCTGGGGCTGAGGTGAAGAAGCCTGGGTCCTCGGTGAAGGTCTCCTGCAAGGCTTCTGGAGGCACCTTCAGCAGC-TATGCTATCAGCTGGGTGCGACAGGCCCCTGGACAAGGGCTTGAGTGGATGGGAGGGATCATCCCTATCTTTGGTACAGCAAAC-TACGCACAGAAGT TCCAGGGCAGAGTCACGATTACCGCGGACGAATCCACGAGCACAGCCTACATGGAGCTGAGCAGCCTGAGA TCT-GAGGACACGGCCGTGTAT-TACTGTGCGAGAGATCCCGCCTACGGTGAC-TACGAGTATGATGCTTTTGATATCTGGGGCCAAGGGACAATGGT-CACCGTCTCTTCAGCGGCCGCACCCAC-CACGACGCCAGCGCCGCGAC CAC-CAACCCCGGCGCCCACGATCGCGTCGCAGCCCCTGTCCCTGCGCCCAGAGGCGTGCCGGCCAGCGGCGGGGGGCGCAGTGCACACGAGGGGGCTGGACTTCGCCTGTGATATCTA-CATCTGGGCGCCCCTGGCCGGGACTTGTGGGGTCCTTCTCCTGTCACTGGTTATCACCCTT-TACTGCAACAAACGGGGCAGAAAGAAGCTCCTGTATATATTCAAACAACCATTTATGAGACCAGTA-CAAACTACTCAAGAGGAAGATGGCTGTAGCTGCC-GATTT CCAGAAGAAGAAGAAGGAGGATGTGAACT-GAGAGTGAAGTTCAGCAGGAGCGCAGAGCCCCCCGCGTACCA GCAGGGCCAGAACCAGCTC-TATAACGAGCTCAATCTAGGACGAAGAGAG-GAGTACGATGTTTTGGACAAGA GACGTGGCCGGGACCCTGAGATGGGGG-GAAAGCCGAGAAGGAAGAACCCTCAG-GAAGGCCTGTACAATGAA CTGCAGAAAGATAA-GATGGCGGAGGCCTACAGTGAGATTGGGATGAAA GGCGAGCGCCGGAGGGGCAAGGG GCAC-GATGGCCTTTACCAGGGTCTCAGTACAGCCAC-CAAGGACACCTACGACGCCCTTCACATGCAGGCCCTGCCCCCTCGCTAACAGCCACTCGAGGATCCG-GATTAGTCCAATTTGTTAAAGACAGGA-TATCAGTGGTCC AGGCTCTAGTTTTGACT-CAACAATATCACCAGCTGAAGCCTATAGAGTACGAGCCATAGATAAAATAAAAG ATTTTATT-TAGTCTCCAGAAAAAGGGGGGAATGAAAGACCCCACCTGTAGGTTTGGCAAGCTAGCTTAAGT AACGCCATTTTGCAAGGCATGGAAAAATACAT-AACTGAGAATAGAGAAGTTCAGATCAAGGTCAG-GAACAG ATGGAACAGCTGAATATGGGCCAAACAG-GATATCTGTGGTAAGCAGTTCCTGCCCCGGCTCAGGGCCAAGA ACAGATGGAACAGCTGAATATGGC-CAAACAGGA-TATCTGTGGTAAGCAGTTCCTGCCCCGGCTCAGGGCC AAGAACAGATGGTCCCCA-GATGCGGTCCAGCCCTCAGCAGTTTCTAGAGAAC-CATCAGATGTTTCCAGGGT GCCCCAAGGACCT-GAAATGACCCTGTGCCTTATTTGAACTAACCAATCAGTTCGCTTCTCGCTTCTGTTCG CGCGCTTCTGCTCCCCGAGCTCAATAAAAGAGCC-CACAACCCCTCACTCGGGGCGCCAGTCCTCCGATTGA CTGAGTCGCCCGGGTACCCGTGTATC-CAATAAACCCTCTTGCAGTTGCATCCGACTTGTGG TCTCGCTGTT CCTTGGGAGGGTCTCCTCTGAGT-GATTGACTACCCGTCAGCGGGGGTCTTTCACA-CATGCAGCATGTATCA AAATTAAT-TTGGTTTTTTTTCTTAAGTATTTACATTAAATGGCCATAGTACTTAAAGTTACATTGGCTTCC TTGAAATAAACATGGAGTATTCAGAATGTGTCAT-AAATATTTCTAATTTTAAGATAGTATCTCCATTGGCTTTCTACTTTTTCTTTTAT-TTTTTTTTGTCCTCTGTCTTCCAT-TTGTTGTTGTTGTTGTTTGTTTGTT TGTTGGTTGGTTGGTTAATTTTTTTTAAAGATCC-TACACTATAGTTCAAGCTAGACTATTAGCTACTCTG TAACCCAGGGTGACCTTGAAGT- CATGGGTAGCCTGCTGTTTTAGCCTTCCCACATCTAAGATTACAGGTAT GAGCTATCATTTTTGGTATATTGATTGATTGATTGATTGATGTGTGTGTGTGTGATTGTGTTTGTGTGTGT GACTGTGAAAATGTGTGTATGGGTGTGTGTGAATGTGTGTATGTATGTGTGTGTGAGTGTGTGTGTGTG
TGTGTGCATGTGTGTGTGTGACTGTGTCTATGTGTATGACTGTGTGTGTGTGTGTGTGTGT GTGTGT GTGTGTGTGTGTGTGTGTTGTGAAAAAATATTCTATGGTAGTGAGAGCCAACGCTCCGGCTCAGGTGTCAG GTTGGTTTTTGAGACAGAGTCTTTCACTTAGCTTGGAATTCACTGGCCGTCGTTTTACAACGTCGTGACTGGGAAAACCCTGGCGTTACCCAACTTAATCGCCTTGCAGCACATCCCCCTTTCGCCAGCTGGCGTAATAGCGAAGAGGCCCGCACCGATCGCCCTTCCCAACAGTTGCGCAGCCTGAATGGCGAATGGCGCCTGATGCGGTAT
TTTCTCCTTACGCATCTGTGCGGTATTTCACACCGCATATGGTGCACTCTCAGTACAATCTGCTCTGATGCCGCATAGTTAAGCCAGCCCCGACACCCGCCAACACCCGCTGACGCGCCCTGACGGGCTTGTCTGCTCCCGG CATCCGCTTACAGACAAGCTGTGACCGTCTCCGGGAGCTGCATGTGTCAGAGGTTTTCACCGTCATCACCGAAACGCGCGATGACGAAAGGGCCTCGTGATACGCCTATTTTTATAGGTTAATGTCATGATAATAATGGTTT CTTAGACGTCAGGTGGCACTTTTCGGGGAAATGTGCGCGGAACCCCTATTTGTTTATTTTTCTAAATACATTCAAATATGTATCCGCTCATGAGACAATAACCCTGATAAATGCTTCAATAATATTGAAAAAGGAAGAGTAT GAGTATTCAACATTTCCGTGTCGCCCTTATTCCCTTTTTTGCGGCATTTTGCCTTCCTGTTTTTGCTCACC CAGAAACGCTGGTGAAAGTAAAAGATGCTGAAGATCAGTTGGGTGCACGAGTGGGTTACATCGAACTGGAT
CTCAACAGCGGTAAGATCCTTGAGAGTTTTCGCCCCGAAGAACGTTTTCCAATGATGAGCACTTTTAAAGT TCTGCTATGTGGCGCGGTATTATCCCGTATTGACGCCGGGCAAGAGCAACTCGGTCGCCGCATACACTATT CTCAGAATGACTTGGTTGAGTACTCACCAGTCACAGAAAAGCATCTTACGGATGGCATGACAGTAAGAGAATTATGCAGTGCTGCCATAACCATGAGTGATAACACTGCGGCCAACTTACTTCTGACAACGATCGGAGGACC GAAGGAGCTAACCGCTTTTTTGCACAACATGGGGGATCATGTAACTCGCCTTGATCGTTGGGAACCGGAGC TGAATGAAGCCATACCAAACGACGAGCGTGACACCACGATGCCTGTAGCAATGGCAACAACGTTGCGCAAACTATTAACTGGCGAACTACTTACTCTAGCTTCCCGGCAACAATTAATAGACTGGATGGAGGCGGATAAAGT TGCAGGACCACTTCTGCGCTCGGCCCTTCCGGCTGGCTGGTTTATTGCTGATAAATCTGGAGCCGGTGAGCGTGGGTCTCGCGGTATCATTGCAGCACTGGGGCCAGATGGTAAGCCCTCCCGTATCGTAGTTATCTACACGACGGGGAGTCAGGCAACTATGGATGAACGAAATAGACAGATCGCTGAGATAGGTGCCTCACTGATTAAGCA TTGGTAACTGTCAGACCAAGTTTACTCATATACTTTAGATTGATTTAAAACTTCATTTTTA ATTTAAAA GGATCTAGGTGAAGATCCTTTTTGATAATCTCATGACCAAAATCCCTTAACGTGAGTTTTCGTTCCACTGA GCGTCAGACCCCGTAGAAAAGATCAAAGGATCTTCTTGAGATCCTTTTTTTCTGCGCGTAATCTGCTGCTT GCAAACAAAAAAACCACCGCTACCAGCGGTGGTTTGTTTGCCGGATCAAGAGCTACCAACTCTTTTTCCGA
AGGTAACTGGCTTCAGCAGAGCGCAGATACCAAATACTGTCCTTCTAGTGTAGCCGTAGTTAGGCCACCAC TTCAAGAACTCTGTAGCACCGCCTACATACCTCGCTCTGCTAATCCTGTTACCAGTGGCTGCTGCCAGTGG CGATAAGTCGTGTCTTACCGGGTTGGACTCAAGACGATAGTTACCGGATAAGGCGCAGCGGTCGGGCTGAA CGGGGGGTTCGTGCACACAGCCCAGCTTGGAGCGAACGACCTACACCGAACTGAGATACCTACAGCGTGAG CATTGAAAGCGCCACGCTTCCCGAAGGGAGAAAGGCGGACAGGTATCCGGTAAGCGGCAGGGTCGGAAC AGGAGAGCGCACGAGGGAGCTTCCAGGGGGAAACGCCTGGTATCTTTATAGTCCTGTCGGGTTTCGCCACC TCTGACTTGAGCGTCGATTTTTGTGATGCTCGTCAGGGGGCGGAGCCTATGGAAAAACGCCAGCAACGCGGCCTTTTTACGGTTCCTGGCCTTTTGCTGGCCTTTTGCTCACATGTTCTTTCCTGCGTTATCCCCTGATTC TGTGGATAACCGTATTACCGCCTTTGAGTGAGCTGATACCGCTCGCCGCAGCCGAACGACCGAGCGCAGCGAGTCAGTGAGCGAGGAAGCGGAAGAGCGCCCAATACGCAAACCGCCTCTCCCCGCGCGTTGGCCGATTCAT
TAATGCAGCTGGCACGACAGGTTTCCCGACTGGAAAGCGGGCAGTGAGCGCAACGCAATTAATGTGAGTTA GCTCACTCATTAGGCACCCCAGGCTTTACACTTTATGCTTCCGGCTCGTATGTTGTGTGGAATT GTGAGCG GATAACAATTTCACACAGGAAACAGCTATGACCATGATTACGCCAAGCTTTGCTCTTAGGAGTTTCCTAAT ACATCCCAAACTCAAATATATAAAAGCATTTGACTTGTTCTATGCCCTA GGGGGCGGGGGGAAGCTAAGCCA GCTTTTTTTAACATTTAAAATGTTAATTCCATTTTAAATGCACAGATGTTTTTATTTCATAAGGGTTTCAA TGTGCATGAATGCTGCAATATTCCTGTTACCAAAGCTAGTAT AAATAAAAATAGATAAACGTGGAAATTAC TTAGAGTTTCTGTCATTAACGTTTCCTTCCTCAGTTGACAACATAAATGCGCTGCTGAGCAAGCCAGTTTG CATCTGTCAGGATCAATTTCCCATTATGCCAGTCATATTAATTACTAGTCAATTAGTTGATTTTTATTTTT GACATATACATGTGAATGAAAGACCCCACCTGTAGGTTTGGCAAGCTAGCTTAAGTAACGCCATTTTGCAA GGCATGGAAAAATACATAACTGAGAATAGAAAAGTTCAGATCAAGGTCAGGAACAGATGGAACAGCTGAAT ATGGGCCAAACAGGATATCTGTGGTAAGCAGTTCCTGCCCCGGCTCAGGG
CCAAGAACAGATGGAACAGCT GAATATGGGCCAAACAGGATATCTGTGGTAAGCAGTTCCTGCCCCGGCTCAGGGCCAAGAACAGATGGTCC CCAGATGCGGTCCAGCCCTCAGCAGTTTCTAGAGAACCATCAGATGTTTCCAGGGTGCCCCAAGGACCTGA AATGACCCTGTGCCTTATTTGAACTAACCAATCAGTTCGCTTCTCGCTTCTGTTCGCGCGCTTATGCTCCC CGAGCTCAATAAAAGAGCCCACAACCCTCACTCGGGGCGCCAGTCCTCCGATTGACTGAGTCGCCCGGGT ACCCGTGTATCCAATAAACCCTCTTGCAGTTGCATCCGACTTGTGGTCTCGCTGTTCCTTGGGAGGGTCTC CTCTGAGTGATTGAC TACCCGTCAGCGGGGGTCTTTCATTTGGGGGCTCG TCCGGGATCGGGAGACCCCTG CCCAGGGACCACCGACCCACCACCGGGAGGTAAGCTGGCCAGCAACTTATCTGTGTCTGTCCGATTGTCTAGTGTCTATGACTGATTTTATGCGCCTGCGTCGGTACTAGTTAGCTAACTAGCTCTGTATCTGGCGGACCCGTGGTGGAACTGACGAGTTCGGAACACCCGGCCGCAACCCTGGGAGACGTCCCAGGGACTTCGGGGGCCGTT TTTGTGGCCCGACCTGAGTCCTAAAATCCCGATCGTTTAGGACTCTTTGGTGCACCCCCCTTAGAGGAGGG ATATGTGGTTCTGGTAGGAGACGAGAACCTAAAACAGTTCCCGCCTCCGTCTG AATTTTTGCTTTCGGTTT GGGACCGAAGCCGCGCCGCGCGTCTTGTCTGCTGCAGCATCGTTCTGTGTTGTCTCTGTCTGACTGTGTTT CTGTATTTGTCTGAAAATATGGGCCCGGGCTAGACTGTTACCACTCCCTTAAGTTTGACCTTAGGTCACTG GAAAGATGTCGAGCGGATCGCTCACAACCAGTCGGTAGATGTCAAGAAGAGACGTT GGGTTACCTTCTGCT CTGCAGAATGGCCAACCTTTAACGTCGGATGGCCGCGAGACGGCACCTTTAACCGAGACCTCATCACCCAG GTTAAGATCAAGGTCTTTTCACCTGGCCCGCATGGACACCCA GACCAGGTCCCCTACATCGTGACCTGGGA AGCCTTGGCTTTTGACCCCCCTCCCTGGGTCAAGCCCTTTGTACACCCTAAGCCTCCGCCTCCTCTTCCTC CATCCGCCCCGTCTCTCCCCCTTGAACCTCCTCGTTCGACCCCGCCTCGATCCTCCCTTTATCCAGCCCTC ACTCCTTCTCTAGGCGCCCCCATATGGCCATATGAGATCTTATATGGGGCACCCCCGCCCCTTGTAAACTT CCCTGACCCTGACATGACAAGAGTTACTAACAGCCCCTCTCTCCAAGCTCACTTACAGGCTCTCTACTTAG TCCAGCACGAAGTCTGGAGACCTCTGGCGGCAGCCTACCAAGAACAACTGGA CCGA [SEQ ID NO: 958]. The isolated nucleic acid molecule having the nucleotide sequence of SEQ ID NO:958 encodes a FcRL-5-targeted CAR (designated as 109 FcRL5-targeted BBz CAR) comprising a fully human scFv (encoded by nucleotides 207-1031) that comprises a heavy chain variable region comprising amino acids having the sequence set forth in SEQ ID NO:236, a light chain variable region comprising amino acids having the sequence set forth in SEQ ID NO:235, and a linker having an amino acid sequence of SEQ ID NO:307 positioned between the heavy chain variable region and the light chain variable region, a transmembrane domain comprising a CD8 polypeptide having 137 to 207 of SEQ ID NO: 960, and an intracellular domain comprising a CD3ζ polypeptide comprising amino acids 52 to 163 of SEQ ID NO: 941, and a co-stimulatory signaling region comprising a 4-1BB polypeptide having amino acids 214-255 of SEQ ID NO: 943. Nucleotides 207-1031 of SEQ ID NO: 957 encodes the human scFv. Nucleotides 1041-1253 of SEQ ID NO: 958 encodes the CD8 polypeptide comprised in the transmembrane domain. Nucleotides 1254-1379 of SEQ ID NO: 958 encodes the 4-1BB polypeptide comprised in the intracellular domain. Nucleotides 1380-1718 of SEQ ID NO: 958 encodes the CD3zeta polypeptide comprised in the intracellular domain. Other portions of SEQ ID NO: 958 are shown in Table 237.

TABLE 237

| Portions | Nucleotide Sequence Positions of SEQ ID NO: 958 | Number of Nucleotides |
| --- | --- | --- |
| anti-FcRL5 scFv 109 | 207 ... 1031 | 825 |
| CD8a TM | 1041 ... 1253 | 213 |
| 4-1BB | 1254 ... 1379 | 126 |
| CD3zeta | 1380 ... 1718 | 339 |
| LTR | 1998 ... 2467 | 470 |
| M13 fwd | 3166 ... 3182 | 17 |
| AmpR promoter | 3657 ... 3761 | 105 |
| AmpR | 3762 ... 4622 | 861 |
| ori | 4793 ... 5381 | 589 |
| CAP binding site | 5669 ... 5690 | 22 |
| lac promoter | 5705 ... 5735 | 31 |
| lac operator | 5743 ... 5759 | 17 |
| M13 rev | 5767 ... 5783 | 17 |
| LTR | 6192 ... 6785 | 594 |
| MMLV Psi | 6848 ... 7205 | 358 |
| gag (truncated) | 7270 ... 7686 | 417 |

In certain embodiments, the isolated nucleic acid molecule comprises nucleic acids having the sequence set forth in SEQ ID NO:959 provided below: CCGGTGGTACCTCACCCTTACCGAGTCGGCGACACAGTGTGGGTCCGCCGAC ACCAGACTAAGAACCTAGA ACCTCGCTGGAAAGGACCTTACACAGTCCTGCTGACCACCCCACCGCCCTCAAAGTAGACGGCATCGCAG CTTGGATACACGCCGCCCACGTGAAGGCTGCCGACCCC GGGGGTGGACCATCCTCTAGACTGCCATGGAAA CCGATACACTGCTGCTGTGGGTGCTGCTGCTGTGGGTGCCAGGATCCACAGGCGATGTTGTGATGACTCAG TCTCCACCCTCCCTGTCCGTCACCCCTGGAGAGCCGGCCTCCATCACCTGCAGGTCTAGTCAGAGCCTCCT GGAAAGAAATGCATACAACTACTTGGATTGGTACCTGCAGAGGCCAGGACAGTCTCCACAGCTCCTGATCT ACTTGGGTTCTAATCGGGCCGCCGGGGTCCCTGA CAGGTTCAGTGGCAGTGGATCAGGCAGAGATTTTACA CTGAAAATCAGCAGAGTGGAGCCTGAGGATGTTGGGGTTTATTACTGCATGCAAGCTCTACAAGCTCCGTT CACTTTCGGCGGAGGGACCAAGGTGGAGATCAAACGTTCTAGAGGTGGTGGTGGTAGCGGCGGC GGCGGCT CTGGTGGTGGTGGATCCCTCGAGATGGCCGAAGTGCAGCTGGTGCA GTCTGGGGGAGGCTTGGTACAGCCT GGGGGGTCCCTGAGACTCTCCTGTGCAGCCTCTGGATTCACCTTTAGCAGCTATGCCATGAGCTGGGTCCG CCAGGCTCCAGGGAAGGGGCTGGAGTGGGTCTCAGCTATTAGTGGT AGTGGTGGTAGCACATACTACGCAG ACTCCGTGAAGGGCCGGTTCACCATCTCCAGAGACAATTCCAAGAACACGCTGTATCTGCAAATGAACAGC CTGAGAGCCGAGGACACGGCCGTATATTACTGTGCGAAATGGGGCCCGTTTCAGGATGCTTTTGATATCTG GGGCCAAGGGACAATGGTCACCGTCTCTTCAGCGGCCGCACCCACCACGACGCCAGCGCCGCGACCACCAA CCCCGGCGCCCACGATCGCGTCGCAGCCCCTGTCCCTGCGCCCAGAGGCGTGCCGGCCAGCGGCGGGGGGC GCAGTGCACACGAGGGGGCTGGACTTCGCCTGTGATATCTACATCTGGGCGCCCCTGGCCGGGACTTGTGG GGTCCTTCTCCTGTCACTGGTTATCACCCTT- TACTGCAACAAACGGGGCAGAAAGAAGCTCCTGTATATAT TCAAACAACCATTTATGAGACCAGTACAAACTACTCAAGAGGAAGATGGCTGTAGCTGCCGATTTCCAGAA GAAGAAGAAGGAGGATGTGAACTGAGAGTGAAGTTCAGCAGGAGCGCAGAGCCCCCGCGTACCAGCAGGG CCAGAACCAGCTCTATAACGAGCTCAATCTAGGACGAAGAGAGGAGTACGATGTTTGGACAAGAGACGTG GCCGGGACCCTGAGATGGGGGGAAAGCCGAGAAGGAAGAACCCTCAGGAAGGCCTGTACAATGAACTGCAG AAAGATAAGATGGCGGAGGCCTACAGTGAGATTGGGATGAAAGGCGAGCGCCGGAGGGGCAAGGGGCACGA TGGCCTTTACCAGGGTCTCAGTACAGCCACCAAGGACACCTACGACGCCCTTCACATGCAGGCCCTGCCCC CTCGCTAACAGCCACTCGAGGATCCGGATTAGTCCAATTTGTTAAAGACAGGATATCAGTGGTCCAGGCTC TAGTTTTGACTCAACAATATCACCAGCTGAAGCCTATAGAGTACGAGCCATAGATAAAATAAAAGATTTTA TTTAGTCTCCAGAAAAAGGGGGGAATGAAAGACCCCACCTGTAGGTTTGGCAAGCTAGCTTAAGTAACGCC ATTTTGCAAGGCATGGAAAAATACATAACTGAGAATAGAGAAGTTCAGATCAAGGTCAGGAACAGATGGAA CAGCTGAATATGGGCCAAACAGGATATCTGTGGTAAGCAGTTCCTGCCCCGGCTCAGGGCCAAGAACAGAT GGAACAGCTGAATATGGGCCAAACAGGATATCTGTGGTAAGCAGTTCCTGCCCCGGCTCAGGGCCAAGAAC AGATGGTCCCAGATGCGGTCCAGCCCTCAGCAGTTTCTAGAGAACCATCAGATGTTTCCAGGGTGCCCCA AGGACCTGAAATGACCCTGTGCCTTATTTGAACTAACCAATCAGTTCGCTTCTCGCTTCTGTTCGCGCGCT TCTGCTCCCCGAGCTCAATAAAAGAGCCCACAACCCCTCACTCGGGGCGCCAGTCCTCCGATTGACTGAGT CGCCCGGGTACCCGTGTATCCAATAAACCCTCTTGCAGTTGCATCCGACTTGTGGTCTCGCTGTTCCTTGG GAGGGTCTCCTCTGAGTGATTGACTACCCGTCAGCGGGGGTCTTTCACACATGCAGCATGTATCAAAATTA ATTTGGTTTTTTTTCTTAAGTATTTACATTAAATGGCCATAGTACTTAAAGTTACATTGGCTTCCTTGAAA TAAACATGGAGTATTCAGAATGTGTCATAAATATTTCTAATTTTAAGATAGTATCTCCATTGGCTTTCTAC TTTTTCTTTTATTTTTTTTTGTCCTCTGTCTTCCATTTGTTGTTGTTGTTGTTTGTTTGTTTGTTTGTTGG TTGGTTGGTTAATTTTTTTTAAAGATCCTACACTATAGTTCAAGCTAGACTATTAGCTACTCTGTAACCC AGGGTGACCTTGAAGTCATGGGTAGCCTGCTGTTTTAGCCTTCCCACATCTAAGATTACAGGTATGAGCTA TCATTTTTGGTATATTGATTGATTGATTGATTGATGTGTGTGTGTGATTGTGTTTGTGTGTGACTGT GAAAATGTGTGTATGGGTGTGTGTGAATGTGTGTATGTATGTGTGTGTGTGAGTGTGTGTGTGTGTGTG CATGTGTGTGTGTGTGACTGTGTCTATGTGTATGACTGTGTGTGTGTGTGTGTGTGT GTGTGTGTGT GTGTGTGTGTTGTGAAAAAATATTCTATGGTAGTGAGAGCCAACGCTCCGGCTCAGGTGTCAGGTTGGT TTTTGAGACAGAGTCTTTCACTTAGCTTGGAATTCACTGGCCGTCGTTTTACAACGTCGTGACTGGGAAAA CCCTGGCGTTACCCAACTTAATCGCCTTGCAGCACATCCCCCTTTCGCCAGCTGGCGTAATAGCGAAGAGG CCCGCACCGATCGCCCTTCC CAACAGTTGCGCAGCCTGAATGGCGAATGGCGCCTGATGCGGTATTTTCTCCTTACGCATCTGTGCGGTATTTCACACCGCATATGGTGCACTCTCAGTACAATCTGCTCTGATGCCGCATA GTTAAGCCAGCCCCGACACCCGCCAACACCCGCTGACGCGCCCTGACGGGCTTGTCTGCTCCCGGCATCCG CTTACAGACAAGCTGTGACCGTCTCCGGGAGCTGCATGTGTCAGAGGTTTTCACCGTCATCACCGAAACGC GCGATGACGAAAGGGCCTCGTGATACGCCTATTTTTATAGGTTAATGTCATGATAATAATGGTTTCTTAGA CGTCAGGTGGCACTTTTCGGGGAAATGTGCGCGGAACCCCTATTTGTTTATTTTTCTAAATACATTCAAAT ATGTATCCGCTCATGAGACAATAACCCTGATAAATGCTTCAATAATATTGAAAAAGGAAGAGTATGAGTAT TCAACATTTCCGTGTCGCCCTTATTCCCTTTTTTGCGGCATTTTGCCTTCCTGTTTTTGCTCACCCAGAAA CGCTGGTGAAAGTAAAAGATGCTGAAGATCAGTTGGGTGCACGAGTGGGTTACATCGAACTGGATCTCAAC AGCGGTAAGATCCTTGAGAGTTTTCGCCCCGAAGAACGTTTTCCAATGATGAGCACTTTTAAAGTTCTGCT ATGTGGCGCGGTATTATCCCGTATTGACGCCGGGCAAGAGCAACTCGGTCGCCGCATACACTATTCTCAGA ATGACTTGGTTGAGTACTCACCAGTCACAGAAAAGCATCTTACGGATGGCATGACAGTAAGAGAATTATGC AGTGCTGCCATAACCATGAGTGATAACACTGCGGCCAACTTACTTCTGACAACGATCGGAGGACCGAAGGA GCTAACCGCTTTTTTGCACAACATGGGGGATCATGTAACTCGCCTTGATCGTTGGGAACCGGAGCTGAATG AAGCCATACCAAACGACGAGCGTGACACCACGATGCCTGTAGCAATGGCAACAACGTTGCGCAAACTATTA ACTGGCGAACTACTTACTCTAGCTTCCCGGCAACAATTAATAGACTGGATGGAGGCGGATAAAGTTGCAGG ACCACTTCTGCGCTCGGCCCTTCCGGCTGGCTGGTTATTGCTGATAAATCTGGAGCCGGTGAGCGTGGGT CTCGCGGTATCATTGCAGCACTGGGGCCAGATGGTAAGCCCTCCCGTATCGTAGTTATCTACACGACGGGG AGTCAGGCAACTATGGATGAACGAAATAGACAGATCGCTGAGATAGGTGCCTCACTGATTAAGCATTGGTA ACTGTCAGACCAAGTTTACTCATATATACTTTAGATTGATTTAAAACTTCATTTTTAATTTAAAAGGATCT AGGTGAAGATCCTTTTTGATAATCTCATGACCAAAATCCCTTAACGTGAGTT TTCGTTCCACTGAGCGTCA GACCCCGTAGAAAAGATCAAAGGATCTTCTTGAGATCCTTTTTTTCTGCGCGTAATCTGCTGCTTGCAAAC AAAAAAACCACCGCTACCAGCGGTGGTTTGTTTGCCGGATCAAGAGCTACCAACTCTTTTTCCGAAGGTAA CTGGCTTCAGCAGAGCGCAGATACCAAATACTGTCCTTCTAGTGTAGCCGTAGTTAGGCCACCACTTCAAG AACTCTGTAGCACCGCCTACATACCTCGCTCTGCTAATCCTGTTACCAGTGGCTGCTGCCAGTGGCGATAA GTCGTGTCTTACCGGGTTGGACTCAAGACGATAGTTACCGGATAAGGCGCAGCGGTCGGGCTGAACGGGGG GTTCGTGCACACAGCCCAGCTTGGAGCGAACGACCTACACCGAACTGAGATACCTACAGCGTGAGCATTGA GAAAGCGCCACGCTTCCCGAAGGGAGAAAGGCGGACAGGTATCCGGTAAGCGGCAGGGTCG GAACAGGAGA GCGCACGAGGGAGCTTCCAGGGGGAAACGCCTGGTATCTTTATAGTCCTGTCGGGTTTCGCCACCTCTGAC TTGAGCGTCGATTTTGTGATGCTCGTCAGGGGGGCGGAGCCTATGGAAAAACGCCAGCAACGCGGCCTTTTTACGGTTCCTGGCCTTTTGCTGGCCTTTTGCTCACATGTTCTTTCCTGCGTTATCCCCTGATTCTGTGGATAACCGTATTACCGCCTTTGAGTGAGCTGATACCGCTCGCCGCAGCCGAACGACCGAGCGCAGCGAGTCAG TGAGCGAGGAAGCGGAAGAGCGCCCAATACGCAAACCGCCTCTCCCCGCGCGTTGGCCGATTCATTAATGCAGCTGGCACGACAGGTTTCCCGACTGGAAAGCGGGCAGTGAGCGCAACGCAATTAATGTGAGTTAGCTCAC TCATTAGGCACCCCAGGCTTTACACTTTATGCTTCCGGCTCGTATGTTGTGTGGAATTGTGAGCGGATAAC AATTTCACACAGGAAACAGCTATGACCATGATTACGCCAAGCTTTGCTCTTAGGAGTTTCCTAATACATCC CAAACTCAAATATATAAAGCATTTGACTTGTTCTATGCCCTAGGGGGCGGGGGGAAGCTAAGCCAGCTTTT TTTAACATTTAAAATGTTAATTCCATTTTAAATGCACAGATGTTTTTATTTCATAAGGGTTTCAATGTGCATGAATGCTGCAATATTCCTGTTACCAAAGCTAGTATAAATAAAAATAGATAAACGTGGAAATTACTTAGAG TTTCTGTCATTAACGTTTCCTTCCTCAGTTGACAACATAAATGCGCTGCTGAGCAAGCCAGTTTGCATCTG TCAGGATCAATTTCCCATTATGCCAGTCATATTAATTACTAGTCAATTAGTTGATTTTTATTTTTGACATA TACATGTGAATGAAAGACCCCACCTGTAGGTTTGGCAAGCTAGCTTAAGTAACGCCATTTTGCAAGGCATGGAAAAATACATAACTGAGAATAGAAAAGTTCAGATCAAGGTCAGGAACAGATGGAACAGCTGAATATGGGC CAAACAGGATATCTGTGGTAAGCAGTTCCTGCCCCGGCTCAGGGCCAAGAACAGATGGAACAGCTGAATAT GGGCCAAACAGGATATCTGTGGTAAGCAGTTCCTGCCCCGGCTCAGGGCCAAGAACAGATGGTCCCCAGATGCGGTCCAGCCCTCAGCAGTTTCTAGAGAACCATCAGATGTTTCCAGGGTGCCCCAAGGACCTGAAATGAC CCTGTGCCTTATTTGAACTAACCAATCAGTTCGCTTCTCGCTTCTGTTCGCGCGCTTATGCTCCCCGAGCT CAATAAAAGAGCCCACAACCCCTCACTCGGGGCGCCAGTCCTCCGATTGACTGAGTCGCCCGGGTACCCGT GTATCCAATAAACCCTCTTGCAGTTGCATCCGACTTGTGGTCTCGCTGTTCCTTGGGAGGGTCTCCTCTGAGTGATTGACTACCCGTCAGCGGGGGTCTTTCATTTGGGGGCTCGTCCGGGATCGGGAGACCCCTGCCCAGG GACCACCGACCCACCACCGGGAGGTAAGCTGGCCAGCAACTTATCTGTGTCTGTCCGATTGTCTAGTGTCT ATGACTGATTTTATGCGCCTGCGTCGGTACTAGTTAGCTAACTAGCTCTGTATCTGGCGGACCCGTGGTGG AACTGACGAGTTCGAACACCCGGCCGCAACCCTGGGAGACGTCCCAGGGACTTCGGGGGCCGTTTTTGTGGCCGACCTGAGTCCTAAAATCCCGATCGTTAGGACTCTTTGGTGCACCCCCCTTAGAGGAGGGATATGT GGTTCTGGTAGGAGACGAGAACCTAAAACAGTTCCCGCCTCCGTCTGAATTTTTGCTTTCGGTTTGGGACCGAAGCCGCGCCGCGCGTCTTGTCTGCTGCAGCATCGTTCTGTGTTGTCTCTGTCTGACTGTGTTTCTGTAT TTGTCTGAAAATATGGGCCCGGGCTAGACTGTTACCACTCCCTTAAGTTTGACCTTAGGTCACTGGAAAGA TGTCGAGCGGATCGCTCACAACCAGTCGGTAGATGTCAAGAAGAGACGTTGGGTTACCTTCTGCTCTGCAG AATGGCCAACCTTTAACGTCGGATGGCCGCGAGACGGCACCTTTAACCGAGACCTCATCACCCAGGTTAAGATCAAGGTCTTTTCACCTGGCCCGCATGGACACCCAGACCAGGTCCCCTACATCGTGACCTGGGAAGCCTT GGCTTTTGACCCCCCTCCCTGGGTCAAGCCCTTTGTACACCCTAAGCCTCCGCCTCCTCTTCCTCCATCCG CCCCGTCTCTCCCCCTTGAACCTCCTCGTTCGACCCCGCCTCGATCCTCCCTTTATCCAGCCCTCACTCCT TCTCTAGGCGCCCCCATATGGCCATATGAGATCTTATATGGGGCACCCCCGCCCCTTGTAAACTTCCCTGA CCCTGACATGACAAGAGTTACTAACAGCCCCTCTCTCCAAGCTCACTTACAGGCTCTCTACTTAGTCCAGC ACGAAGTCTGGAGACCTCTGGCGGCAGCCTACCAAGAACAACTGGACCGA [SEQ ID NO: 959]. The isolated nucleic acid molecule having the nucleotide sequence of SEQ ID NO:959 encodes a FcRL-5-targeted CAR (designated as 117 FcRL5-targeted BBz CAR) comprising a fully human scFv (encoded by nucleotides 207-1025 of SEQ ID NO:959) that comprises a heavy chain variable region comprising amino acids having the sequence set forth in SEQ ID NO:268, a light chain variable region comprising amino acids having the sequence set forth in SEQ ID NO:267, and a linker having an amino acid sequence of SEQ ID NO:307 positioned between the heavy chain variable region and the light chain variable region, a transmembrane domain comprising a CD8 polypeptide having 137 to 207 of SEQ ID NO: 960, and an intracellular domain comprising a CD3ζ polypeptide comprising amino acids 52 to 163 of SEQ ID NO: 941, and a co-stimulatory signaling region comprising a 4-1BB polypeptide having amino acids 214-255 of SEQ ID NO: 943. Nucleotides 207-1025 of SEQ ID NO: 959 encodes the human scFv. Nucleotides 1035-1247 of SEQ ID NO: 959 encodes the CD8 polypeptide comprised in the transmembrane domain. Nucleotides 1248-1373 of SEQ ID NO: 959 encodes the 4-1BB polypeptide comprised in the intracellular domain. Nucleotides 1374-1712 of SEQ ID NO: 959 encodes the CD3zeta polypeptide comprised in the intracellular domain. Other portions of SEQ ID NO: 959 are shown in Table 238.

TABLE 238

| Portions | Nucleotide Sequence Positions of SEQ ID NO: 959 | Number of Nucleotides |
|---|---|---|
| anti-FcRL5 scFv 117 | 207 ... 1025 | 819 |
| CD8a TM | 1035 ... 1247 | 213 |
| 4-1BB | 1248 ... 1373 | 126 |
| CD3zeta | 1374 ... 1712 | 339 |
| LTR | 1992 ... 2461 | 470 |
| M13 fwd | 3160 ... 3176 | 17 |
| AmpR promoter | 3651 ... 3755 | 105 |
| AmpR | 3756 ... 4616 | 861 |
| ori | 4787 ... 5375 | 589 |
| CAP binding site | 5663 ... 5684 | 22 |
| lac promoter | 5699 ... 5729 | 31 |
| lac operator | 5737 ... 5753 | 17 |
| M13 rev | 5761 ... 5777 | 17 |

TABLE 238-continued

| Portions | Nucleotide Sequence Positions of SEQ ID NO: 959 | Number of Nucleotides |
|---|---|---|
| LTR | 6186 . . . 6779 | 594 |
| MMLV Psi | 6842 . . . 7199 | 358 |
| gag (truncated) | 7264 . . . 7680 | 417 |

In certain embodiments, the isolated nucleic acid molecule encodes a functional portion of a presently disclosed FcRL5-targeted CAR. As used herein, the term "functional portion" refers to any portion, part or fragment of a presently disclosed FcRL5-targeted CAR, which portion, part or fragment retains the biological activity of the FcRL5-targeted CAR (the parent CAR). For example, functional portions encompass the portions, parts or fragments of a presently disclosed FcRL5-targeted CAR that retains the ability to recognize a target cell, to treat a disease, e.g., multiple myeloma, to a similar, same, or even a higher extent as the parent CAR. In certain embodiments, an isolated nucleic acid molecule encoding a functional portion of a presently disclosed FcRL5-targeted CAR can encode a protein comprising, e.g., about 10%, 20%, 25%, 30%, 35%, 40%, 45%, 50%, 55%, 60%, 65%, 70%, 75%, 80%, 85%, 90%, and 95%, or more of the parent CAR, e.g., of the nucleic acid sequences set forth in SEQ ID NO:951, SEQ ID NO:952, SEQ ID NO:953, SEQ ID NO:954, SEQ ID NO:955, SEQ ID NO:956, SEQ ID NO:957, SEQ ID NO:958 or SEQ ID NO:959.

III. Immunoresponsive Cells

The presently disclosed subject matter provides immunoresponsive cells expressing a CAR that comprises an extracellular antigen-binding domain, a transmembrane domain and an intracellular domain, where the extracellular antigen-binding domain specifically binds to FcRL5 (e.g., human FcRL5), as described above. In certain embodiments, the extracellular antigen-binding domain specifically binds to domain 7 of FcRL5. In certain embodiments, the extracellular antigen-binding domain specifically binds to domain 8 of FcRL5. In certain embodiments, the extracellular antigen-binding domain specifically binds to domain 9 of FcRL5. The immunoresponsive cells can be transduced with a presently disclosed CAR such that the cells express the CAR. The presently disclosed subject matter also provides methods of using such cells for the treatment of a tumor, e.g., multiple myeloma (MM). The immunoresponsive cells of the presently disclosed subject matter can be cells of the lymphoid lineage. The lymphoid lineage, comprising B, T and natural killer (NK) cells, provides for the production of antibodies, regulation of the cellular immune system, detection of foreign agents in the blood, detection of cells foreign to the host, and the like. Non-limiting examples of immunoresponsive cells of the lymphoid lineage include T cells, Natural Killer (NK) cells, cytotoxic T lymphocytes (CTLs), regulatory T cells, embryonic stem cells, and pluripotent stem cells (e.g., those from which lymphoid cells may be differentiated). T cells can be lymphocytes that mature in the thymus and are chiefly responsible for cell-mediated immunity. T cells are involved in the adaptive immune system. The T cells of the presently disclosed subject matter can be any type of T cells, including, but not limited to, T helper cells, cytotoxic T cells, memory T cells (including central memory T cells, stem-cell-like memory T cells (or stem-like memory T cells), and two types of effector memory T cells: e.g., $T_{EM}$ cells and $T_{EMRA}$ cells), Regulatory T cells (also known as suppressor T cells), Natural killer T cells, Mucosal associated invariant T cells, and γδ T cells. In certain embodiments, the CAR-expressing T cells express Foxp3 to achieve and maintain a T regulatory phenotype. Natural killer (NK) cells can be lymphocytes that are part of cell-mediated immunity and act during the innate immune response. NK cells do not require prior activation in order to perform their cytotoxic effect on target cells. Cytotoxic T cells (CTL or killer T cells) are a subset of T lymphocytes capable of inducing the death of infected somatic or tumor cells.

The immunoresponsive cells of the presently disclosed subject matter can express an extracellular antigen-binding domain (e.g., an scFV, a Fab that is optionally crosslinked, or a F(ab)$_2$) that specifically binds to FcRL5 (e.g., human FcRL5), for the treatment of multiple myeloma. Such immunoresponsive cells can be administered to a subject (e.g., a human subject) in need thereof for the treatment of multiple myeloma. In certain embodiments, the immunoresponsive cell is a T cell. The T cell can be a CD4$^+$ T cell or a CD8$^+$ T cell. In certain embodiments, the T cell is a CD4$^+$ T cell. In another embodiment, the T cell is a CD8$^+$ T cell.

A presently disclosed immunoresponsive cell can be further transduced with at least one co-stimulatory ligand, such that the immunoresponsive cell co-expresses or is induced to co-express the FcRL5-specific CAR and the at least one co-stimulatory ligand. The interaction between the FcRL5-specific CAR and at least one co-stimulatory ligand provides a non-antigen-specific signal important for full activation of an immunoresponsive cell (e.g., T cell). Co-stimulatory ligands include, but are not limited to, members of the tumor necrosis factor (TNF) superfamily, and immunoglobulin (Ig) superfamily ligands. TNF is a cytokine involved in systemic inflammation and stimulates the acute phase reaction. Its primary role is in the regulation of immune cells. Members of TNF superfamily share a number of common features. The majority of TNF superfamily members are synthesized as type II transmembrane proteins (extracellular C-terminus) containing a short cytoplasmic segment and a relatively long extracellular region. TNF superfamily members include, without limitation, nerve growth factor (NGF), CD40L (CD40L)/CD154, CD137L/4-1BBL, TNF-α, CD134L/OX40L/CD252, CD27L/CD70, Fas ligand (FasL), CD30L/CD153, tumor necrosis factor beta (TNFβ)/lymphotoxin-alpha (LTα), lymphotoxin-beta (LTβ), CD257/B cell-activating factor (BAFF)/Blys/THANK/Tall-1, glucocorticoid-induced TNF Receptor ligand (GITRL), and TNF-related apoptosis-inducing ligand (TRAIL), LIGHT (TNFSF14). The immunoglobulin (Ig) superfamily is a large group of cell surface and soluble proteins that are involved in the recognition, binding, or adhesion processes of cells. These proteins share structural features with immunoglobulins—they possess an immunoglobulin domain (fold). Immunoglobulin superfamily ligands include, but are not limited to, CD80 and CD86, both ligands for CD28, PD-L1/(B7-H1) that ligands for PD-1. In certain embodiments, the at least one co-stimulatory ligand is selected from the group consisting of 4-1BBL, CD80, CD86, CD70, OX40L, CD48, TNFRSF14, PD-L1, and combinations thereof. In certain embodiments, the immunoresponsive cell is transduced with one co-stimulatory ligand that is 4-1BBL. In certain embodiments, the immunoresponsive cell is transduced with two co-stimulatory ligands that are 4-1BBL and CD80. CARs transduced with at least one co-stimulatory ligand are described in U.S. Pat. No. 8,389,282, which is incorporated by reference in its entirety.

Furthermore, a presently disclosed immunoresponsive cell can be further transduced with at least one cytokine, such that the immunoresponsive cell secretes the at least one cytokine as well as expresses the FcRL5-specific CAR. In certain embodiments, the at least one cytokine is selected from the group consisting of IL-2, IL-3, IL-6, IL-7, IL-11, IL-12, IL-15, IL-17, and IL-21. In certain embodiments, the cytokine is IL-12.

The FcRL5-specific or FcRL5-targeted human lymphocytes that can be used in peripheral donor lymphocytes, e.g., those disclosed in Sadelain, M., et al. 2003 Nat Rev Cancer 3:35-45 (disclosing peripheral donor lymphocytes genetically modified to express CARs), in Morgan, R. A., et al. 2006 Science 314:126-129 (disclosing peripheral donor lymphocytes genetically modified to express a full-length tumor antigen-recognizing T cell receptor complex comprising the α and β heterodimer), in Panelli, M. C., et al. 2000 J Immunol 164:495-504; Panelli, M. C., et al. 2000 J Immunol 164:4382-4392 (disclosing lymphocyte cultures derived from tumor infiltrating lymphocytes (TILs) in tumor biopsies), and in Dupont, J., et al. 2005 Cancer Res 65:5417-5427; Papanicolaou, G. A., et al. 2003 Blood 102:2498-2505 (disclosing selectively in vitro-expanded antigen-specific peripheral blood leukocytes employing artificial antigen-presenting cells (AAPCs) or pulsed dendritic cells). The immunoresponsive cells (e.g., T cells) can be autologous, non-autologous (e.g., allogeneic), or derived in vitro from engineered progenitor or stem cells.

In certain embodiments, a presently disclosed immunoresponsive cell (e.g., T cell) expresses from about 1 to about 4, from about 2 to about 4, from about 3 to about 4, from about 1 to about 2, from about 1 to about 3, or from about 2 to about 3 vector copy numbers/cell of a presently disclosed FcRL5-specific CAR.

The unpurified source of CTLs may be any known in the art, such as the bone marrow, fetal, neonate or adult or other hematopoietic cell source, e.g., fetal liver, peripheral blood or umbilical cord blood. Various techniques can be employed to separate the cells. For instance, negative selection methods can remove non-CTLs initially. Monoclonal antibodies are particularly useful for identifying markers associated with particular cell lineages and/or stages of differentiation for both positive and negative selections.

A large proportion of terminally differentiated cells can be initially removed by a relatively crude separation. For example, magnetic bead separations can be used initially to remove large numbers of irrelevant cells. Preferably, at least about 80%, usually at least 70% of the total hematopoietic cells will be removed prior to cell isolation.

Procedures for separation include, but are not limited to, density gradient centrifugation; resetting; coupling to particles that modify cell density; magnetic separation with antibody-coated magnetic beads; affinity chromatography; cytotoxic agents joined to or used in conjunction with a mAb, including, but not limited to, complement and cytotoxins; and panning with antibody attached to a solid matrix, e.g. plate, chip, elutriation or any other convenient technique.

Techniques for separation and analysis include, but are not limited to, flow cytometry, which can have varying degrees of sophistication, e.g., a plurality of color channels, low angle and obtuse light scattering detecting channels, impedance channels. The cells can be selected against dead cells, by employing dyes associated with dead cells such as propidium iodide (PI). Preferably, the cells are collected in a medium comprising 2% fetal calf serum (FCS) or 0.2% bovine serum albumin (BSA) or any other suitable, preferably sterile, isotonic medium.

IV. Vectors

Genetic modification of immunoresponsive cells (e.g., T cells, CTL cells, NK cells) can be accomplished by transducing a substantially homogeneous cell composition with a recombinant DNA or RNA construct. The vector can be a retroviral vector (e.g., gamma retroviral), which is employed for the introduction of the DNA or RNA construct into the host cell genome. For example, a polynucleotide encoding the FcRL5-specific CAR can be cloned into a retroviral vector and expression can be driven from its endogenous promoter, from the retroviral long terminal repeat, or from an alternative internal promoter.

Non-viral vectors or RNA may be used as well. Random chromosomal integration, or targeted integration (e.g., using a nuclease, transcription activator-like effector nucleases (TALENs), Zinc-finger nucleases (ZFNs), and/or clustered regularly interspaced short palindromic repeats (CRISPRs), or transgene expression (e.g., using a natural or chemically modified RNA) can be used.

For initial genetic modification of the cells to provide FcRL5-specific CAR expressing cells, a retroviral vector is generally employed for transduction, however any other suitable viral vector or non-viral delivery system can be used. For subsequent genetic modification of the cells to provide cells comprising an antigen presenting complex comprising at least two co-stimulatory ligands, retroviral gene transfer (transduction) likewise proves effective. Combinations of retroviral vector and an appropriate packaging line are also suitable, where the capsid proteins will be functional for infecting human cells. Various amphotropic virus-producing cell lines are known, including, but not limited to, PA12 (Miller, et al. (1985) Mol. Cell. Biol. 5:431-437); PA317 (Miller, et al. (1986) Mol. Cell. Biol. 6:2895-2902); and CRIP (Danos, et al. (1988) Proc. Natl. Acad. Sci. USA 85:6460-6464). Non-amphotropic particles are suitable too, e.g., particles pseudotyped with VSVG, RD114 or GALV envelope and any other known in the art.

Possible methods of transduction also include direct co-culture of the cells with producer cells, e.g., by the method of Bregni, et al. (1992) Blood 80:1418-1422, or culturing with viral supernatant alone or concentrated vector stocks with or without appropriate growth factors and polycations, e.g., by the method of Xu, et al. (1994) Exp. Hemat. 22:223-230; and Hughes, et al. (1992) J Clin. Invest. 89:1817.

Transducing viral vectors can be used to express a co-stimulatory ligand (e.g., 4-1BBL and IL-12) in an immunoresponsive cell. Preferably, the chosen vector exhibits high efficiency of infection and stable integration and expression (see, e.g., Cayouette et al., Human Gene Therapy 8:423-430, 1997; Kido et al., Current Eye Research 15:833-844, 1996; Bloomer et al., Journal of Virology 71:6641-6649, 1997; Naldini et al., Science 272:263 267, 1996; and Miyoshi et al., Proc. Natl. Acad. Sci. U.S.A. 94:10319, 1997). Other viral vectors that can be used include, for example, adenoviral, lentiviral, and adeno-associated viral vectors, vaccinia virus, a bovine papilloma virus, or a herpes virus, such as Epstein-Barr Virus (also see, for example, the vectors of Miller, Human Gene Therapy 15-14, 1990; Friedman, Science 244:1275-1281, 1989; Eglitis et al., BioTechniques 6:608-614, 1988; Tolstoshev et al., Current Opinion in Biotechnology 1:55-61, 1990; Sharp, The Lancet 337:1277-1278, 1991; Cornetta et al., Nucleic Acid Research and Molecular Biology 36:311-322, 1987; Anderson, Science 226:401-409, 1984; Moen, Blood Cells 17:407-416, 1991; Miller et al., Biotechnology 7:980-990, 1989; Le Gal La Salle et al., Science 259:988-990, 1993; and Johnson, Chest 107:77S-83S, 1995). Retroviral vectors are particularly well developed and have been used in clinical settings (Rosenberg et al., N. Engl. J. Med 323:370, 1990; Anderson et al., U.S. Pat. No. 5,399,346).

In certain non-limiting embodiments, the vector expressing a presently disclosed FcRL5-targeted CAR is a retroviral vector, e.g., a 293galv9 retroviral vector.

Non-viral approaches can also be employed for the expression of a protein in cell. For example, a nucleic acid molecule can be introduced into a cell by administering the nucleic acid in the presence of lipofection (Feigner et al., Proc. Nat'l. Acad. Sci. U.S.A. 84:7413, 1987; Ono et al., Neuroscience Letters 17:259, 1990; Brigham et al., Am. J. Med. Sci. 298:278, 1989; Staubinger et al., Methods in Enzymology 101:512, 1983), asialoorosomucoid-polylysine conjugation (Wu et al., Journal of Biological Chemistry 263:14621, 1988; Wu et al., Journal of Biological Chemistry 264:16985, 1989), or by micro-injection under surgical conditions (Wolff et al., Science 247:1465, 1990). Other non-viral means for gene transfer include transfection in vitro using calcium phosphate, DEAE dextran, electroporation, and protoplast fusion. Liposomes can also be potentially beneficial for delivery of DNA into a cell. Transplantation of normal genes into the affected tissues of a subject can also be accomplished by transferring a normal nucleic acid into a cultivatable cell type ex vivo (e.g., an autologous or heterologous primary cell or progeny thereof), after which the cell (or its descendants) are injected into a targeted tissue or are injected systemically. Recombinant receptors can also be derived or obtained using transposases or targeted nucleases (e.g. Zinc finger nucleases, meganucleases, or TALE nucleases). Transient expression may be obtained by RNA electroporation.

cDNA expression for use in polynucleotide therapy methods can be directed from any suitable promoter (e.g., the human cytomegalovirus (CMV), simian virus 40 (SV40), or metallothionein promoters), and regulated by any appropriate mammalian regulatory element or intron (e.g. the elongation factor 1 α enhancer/promoter/intron structure). For example, if desired, enhancers known to preferentially direct gene expression in specific cell types can be used to direct the expression of a nucleic acid. The enhancers used can include, without limitation, those that are characterized as tissue- or cell-specific enhancers. Alternatively, if a genomic clone is used as a therapeutic construct, regulation can be mediated by the cognate regulatory sequences or, if desired, by regulatory sequences derived from a heterologous source, including any of the promoters or regulatory elements described above.

The resulting cells can be grown under conditions similar to those for unmodified cells, whereby the modified cells can be expanded and used for a variety of purposes.

V. Polypeptides and Analogs and Polynucleotides

Also included in the presently disclosed subject matter are extracellular antigen-binding domains that specifically binds to FcRL5 (e.g., human FcRL5) (e.g., an scFv, such as an scFv derived from antibodies F56 and F119, a Fab, or a (Fab)$_2$), CD3ζ, CD8, CD28, etc. polypeptides or fragments thereof, and polynucleotides encoding thereof that are modified in ways that enhance their anti-tumor activity when expressed in an immunoresponsive cell. In certain embodiments, the presently disclosed subject matter further provides extracellular antigen-binding domains that specifically binds to domain 9 FcRL5 (e.g., domain 7, domain 8 or domain 9 of human FcRL5) (e.g., an scFv, a Fab, or a (Fab)$_2$), CD3ζ, CD8, CD28, etc. polypeptides or fragments thereof, and polynucleotides encoding thereof that are modified in ways that enhance their anti-tumor activity when expressed in an immunoresponsive cell.

The presently disclosed subject matter provides methods for optimizing an amino acid sequence or a nucleic acid sequence by producing an alteration in the sequence. Such alterations may comprise certain mutations, deletions, insertions, or post-translational modifications. The presently disclosed subject matter further comprises analogs of any naturally-occurring polypeptide of the presently disclosed subject matter. Analogs can differ from a naturally-occurring polypeptide of the presently disclosed subject matter by amino acid sequence differences, by post-translational modifications, or by both. Analogs of the presently disclosed subject matter can generally exhibit at least about 85%, about 90%, about 91%, about 92%, about 93%, about 94%, about 95%, about 96%, about 97%, about 98%, about 99% or more identity with all or part of a naturally-occurring amino, acid sequence of the presently disclosed subject matter. The length of sequence comparison is at least 5, 10, 15, 20, 25, 50, 75, 100 or more amino acid residues. Again, in an exemplary approach to determining the degree of identity, a BLAST program may be used, with a probability score between $e^{-3}$ and $e^{-100}$ indicating a closely related sequence. Modifications comprise in vivo and in vitro chemical derivatization of polypeptides, e.g., acetylation, carboxylation, phosphorylation, or glycosylation; such modifications may occur during polypeptide synthesis or processing or following treatment with isolated modifying enzymes. Analogs can also differ from the naturally-occurring polypeptides of the presently disclosed subject matter by alterations in primary sequence. These include genetic variants, both natural and induced (for example, resulting from random mutagenesis by irradiation or exposure to ethanemethylsulfate or by site-specific mutagenesis as described in Sambrook, Fritsch and Maniatis, Molecular Cloning: A Laboratory Manual (2d ed.), CSH Press, 1989, or Ausubel et al., supra). Also included are cyclized peptides, molecules, and analogs which contain residues other than L-amina acids, e.g., D-amino acids or non-naturally occurring or synthetic amino acids, e.g., beta (β) or gamma (γ) amino acids.

In addition to full-length polypeptides, the presently disclosed subject matter also provides fragments of any one of the polypeptides or peptide domains of the presently disclosed subject matter. A fragment can be at least 5, 10, 13, or 15 amino acids. In certain embodiments, a fragment is at least 20 contiguous amino acids, at least 30 contiguous amino acids, or at least 50 contiguous amino acids. In certain embodiments, a fragment is at least 60 to 80, 100, 200, 300 or more contiguous amino acids. Fragments of the presently disclosed subject matter can be generated by methods known to those of ordinary skill in the art or may result from normal protein processing (e.g., removal of amino acids from the nascent polypeptide that are not required for biological activity or removal of amino acids by alternative mRNA splicing or alternative protein processing events).

Non-protein analogs have a chemical structure designed to mimic the functional activity of a protein of the invention. Such analogs are administered according to methods of the presently disclosed subject matter. Such analogs may exceed the physiological activity of the original polypeptide. Methods of analog design are well known in the art, and synthesis of analogs can be carried out according to such methods by modifying the chemical structures such that the resultant analogs increase the anti-neoplastic activity of the original polypeptide when expressed in an immunoresponsive cell. These chemical modifications include, but are not limited to, substituting alternative R groups and varying the degree of saturation at specific carbon atoms of a reference polypeptide. The protein analogs can be relatively resistant to in vivo degradation, resulting in a more prolonged therapeutic effect upon administration. Assays for measuring functional activity include, but are not limited to, those described in the Examples below.

In accordance with the presently disclosed subject matter, the polynucleotides encoding an extracellular antigen-binding domain that specifically binds to FcRL5 (e.g., an scFV (e.g., an scFv derived from antibodies F56 and F119), a Fab, Fab' or a (Fab')$_2$), CD3ζ, CD8, CD28) can be modified by codon optimization. Codon optimization can alter both naturally occurring and recombinant gene sequences to achieve the highest possible levels of productivity in any given expression system. Factors that are involved in different stages of protein expression include codon adaptability, mRNA structure, and various cis-elements in transcription and translation. Any suitable codon optimization methods or technologies that are known to ones skilled in the art can be used to modify the polynucleotids of the presently disclosed subject matter, including, but not limited to, OPTIMUMGENE™, Encor optimization, and Blue Heron.

VI. Administration

FcRL5-specific CARs and immunoresponsive cells expressing thereof of the presently disclosed subject matter can be provided systemically or directly to a subject for treating or preventing a neoplasia. In certain embodiments, the FcRL5-specific CARs and immunoresponsive cells expressing thereof are directly injected into an organ of interest (e.g., an organ affected by a neoplasia). Alternatively or additionally, the FcRL5-specific CARs and immunoresponsive cells expressing thereof are provided indirectly to the organ of interest, for example, by administration into the circulatory system (e.g., the tumor vasculature). Expansion and differentiation agents can be provided prior to, during or after administration of cells and compositions to increase production of T cells in vitro or in vivo.

FcRL5-specific CARs and immunoresponsive cells expressing thereof of the presently disclosed subject matter can be administered in any physiologically acceptable vehicle, normally intravascularly, although they may also be introduced into bone or other convenient site where the cells may find an appropriate site for regeneration and differentiation (e.g., thymus). Usually, at least $1\times10^5$ cells can be administered, eventually reaching $1\times10^{10}$ or more. A cell population comprising immunoresponsive cells expressing a FcRL5-specific CAR can comprise a purified population of cells. Those skilled in the art can readily determine the percentage of immunoresponsive cells in a cell population using various well-known methods, such as fluorescence activated cell sorting (FACS). The ranges of purity in cell populations comprising genetically modified immunoresponsive cells expressing a FcRL5-specific CAR can be from about 50% to about 55%, from about 55% to about 60%, from about 65% to about 70%, from about 70% to about 75%, from about 75% to about 80%, from about 80% to about 85%; from about 85% to about 90%, from about 90% to about 95%, or from about 95 to about 100%. Dosages can be readily adjusted by those skilled in the art (e.g., a decrease in purity may require an increase in dosage). The immunoresponsive cells can be introduced by injection, catheter, or the like. If desired, factors can also be included, including, but not limited to, interleukins, e.g. IL-2, IL-3, IL 6, IL-11, IL-7, IL-12, IL-15, IL-21, as well as the other interleukins, the colony stimulating factors, such as G-, M- and GM-CSF, interferons, e.g., γ-interferon.

Compositions of the presently disclosed subject matter comprise pharmaceutical compositions comprising immunoresponsive cells expressing a FcRL5-specific CAR and a pharmaceutically acceptable carrier. Administration can be autologous or non-autologous. For example, immunoresponsive cells expressing a FcRL5-specific CAR and compositions comprising thereof can be obtained from one subject, and administered to the same subject or a different, compatible subject. Peripheral blood derived T cells of the presently disclosed subject matter or their progeny (e.g., in vivo, ex vivo or in vitro derived) can be administered via localized injection, including catheter administration, systemic injection, localized injection, intravenous injection, or parenteral administration. When administering a pharmaceutical composition of the presently disclosed subject matter (e.g., a pharmaceutical composition comprising immunoresponsive cells expressing a FcRL5-specific CAR), it can be formulated in a unit dosage injectable form (solution, suspension, emulsion).

VII. Formulations

Immunoresponsive cells expressing a generally FcRL5-specific CAR and compositions comprising thereof of the presently disclosed subject matter can be conveniently provided as sterile liquid preparations, e.g., isotonic aqueous solutions, suspensions, emulsions, dispersions, or viscous compositions, which may be buffered to a selected pH. Liquid preparations are normally easier to prepare than gels, other viscous compositions, and solid compositions. Additionally, liquid compositions are somewhat more convenient to administer, especially by injection. Viscous compositions, on the other hand, can be formulated within the appropriate viscosity range to provide longer contact periods with specific tissues. Liquid or viscous compositions can comprise carriers, which can be a solvent or dispersing medium containing, for example, water, saline, phosphate buffered saline, polyol (for example, glycerol, propylene glycol, liquid polyethylene glycol, and the like) and suitable mixtures thereof.

Sterile injectable solutions can be prepared by incorporating the compositions comprising immunoresponsive cells expressing a generally FcRL5-specific CAR of the presently disclosed subject matter in the required amount of the appropriate solvent with various amounts of the other ingredients, as desired. Such compositions may be in admixture with a suitable carrier, diluent, or excipient such as sterile water, physiological saline, glucose, dextrose, or the like. The compositions can also be lyophilized. The compositions can contain auxiliary substances such as wetting, dispersing, or emulsifying agents (e.g., methylcellulose), pH buffering agents, gelling or viscosity enhancing additives, preservatives, flavoring agents, colors, and the like, depending upon the route of administration and the preparation desired. Standard texts, such as "REMINGTON'S PHARMACEUTICAL SCIENCE," 17th edition, 1985, incorporated herein by reference, may be consulted to prepare suitable preparations, without undue experimentation.

Various additives which enhance the stability and sterility of the compositions, including antimicrobial preservatives, antioxidants, chelating agents, and buffers, can be added. Prevention of the action of microorganisms can be ensured by various antibacterial and antifungal agents, for example, parabens, chlorobutanol, phenol, sorbic acid, and the like. Prolonged absorption of the injectable pharmaceutical form can be brought about by the use of agents delaying absorption, for example, alum inurn monostearate and gelatin. According to the present invention, however, any vehicle, diluent, or additive used would have to be compatible with the immunoresponsive cells expressing a generally FcRL5-specific CAR of the presently disclosed subject matter.

The compositions can be isotonic, i.e., they can have the same osmotic pressure as blood and lacrimal fluid. The desired isotonicity of the compositions of the presently disclosed subject matter may be accomplished using sodium chloride, or other pharmaceutically acceptable agents such as dextrose, boric acid, sodium tartrate, propylene glycol or other inorganic or organic solutes. Sodium chloride is preferred particularly for buffers containing sodium ions.

Viscosity of the compositions, if desired, can be maintained at the selected level using a pharmaceutically acceptable thickening agent. Methylcellulose can be used because it is readily and economically available and is easy to work with. Other suitable thickening agents include, for example, xanthan gum, carboxymethyl cellulose, hydroxypropyl cellulose, carbomer, and the like. The concentration of the thickener can depend upon the agent selected. The important point is to use an amount that will achieve the selected viscosity. Obviously, the choice of suitable carriers and other additives will depend on the exact route of administration and the nature of the particular dosage form, e.g., liquid dosage form (e.g., whether the composition is to be formulated into a solution, a suspension, gel or another liquid form, such as a time release form or liquid-filled form).

Those skilled in the art will recognize that the components of the compositions should be selected to be chemically inert and will not affect the viability or efficacy of the immunoresponsive cells as describe in the presently disclosed subject matter. This will present no problem to those skilled in chemical and pharmaceutical principles, or problems can be readily avoided by reference to standard texts or by simple experiments (not involving undue experimentation), from this disclosure and the documents cited herein.

One consideration concerning the therapeutic use of the immunoresponsive cells of the presently disclosed subject matter is the quantity of cells necessary to achieve an optimal effect. The quantity of cells to be administered will vary for the subject being treated. In certain embodiments, from about $10^4$ to about $10^{10}$, from about $10^5$ to about $10^9$, or from about $10^6$ to about $10^8$ immunoresponsive cells of the presently disclosed subject matter are administered to a subject. More effective cells may be administered in even smaller numbers. In certain embodiments, at least about $1\times10^8$, about $2\times10^8$, about $3\times10^8$, about $4\times10^8$, and about $5\times10^8$ immunoresponsive cells of the presently disclosed subject matter are administered to a human subject. The precise determination of what would be considered an effective dose may be based on factors individual to each subject, including their size, age, sex, weight, and condition of the particular subject. Dosages can be readily ascertained by those skilled in the art from this disclosure and the knowledge in the art.

The skilled artisan can readily determine the amount of cells and optional additives, vehicles, and/or carrier in compositions and to be administered in methods of the presently disclosed subject matter. Typically, any additives (in addition to the active cell(s) and/or agent(s)) are present in an amount of from about 0.001% to about 50% by weight) solution in phosphate buffered saline, and the active ingredient is present in the order of micrograms to milligrams, such as from about 0.0001 wt % to about 5 wt %, from about 0.0001 wt % to about 1 wt %, from about 0.0001 wt % to about 0.05 wt %, from about 0.001 wt % to about 20 wt %, from about 0.01 wt % to about 10 wt %, or from about 0.05 wt % to about 5 wt %. For any composition to be administered to an animal or human, and for any particular method of administration, toxicity should be determined, such as by determining the lethal dose (LD) and LD50 in a suitable animal model e.g., rodent such as mouse; and, the dosage of the composition(s), concentration of components therein and timing of administering the composition(s), which elicit a suitable response. Such determinations do not require undue experimentation from the knowledge of the skilled artisan, this disclosure and the documents cited herein. And, the time for sequential administrations can be ascertained without undue experimentation.

VIII. Methods of Treatment

Tumor Microenvironment.

Tumors have a microenvironment that is hostile to the host immune response involving a series of mechanisms by malignant cells to protect themselves from immune recognition and elimination. This "hostile tumor microenvironment" comprises a variety of immune suppressive factors including infiltrating regulatory $CD4^+$ T cells (Tregs), myeloid derived suppressor cells (MDSCs), tumor associated macrophages (TAMs), immune suppressive cytokines including IL-10 and TGF-β, and expression of ligands targeted to immune suppressive receptors expressed by activated T cells (CTLA-4 and PD-1). These mechanisms of immune suppression play a role in the maintenance of tolerance and suppressing inappropriate immune responses, however within the tumor microenvironment these mechanisms prevent an effective anti-tumor immune response. Collectively these immune suppressive factors can induce either marked anergy or apoptosis of adoptively transferred CAR modified T cells upon encounter with targeted tumor cells.

Challenges in Tumor Immunology.

Effective tumor immunity requires recognition of tumor antigens and unopposed tumor elimination by immune effector cells. Tumor antigens must contain peptide epitopes that are presented by the tumor and can be recognized by specific cytotoxic T lymphocytes (CTLs). The primed CTLs must expand to a sufficient number and migrate to tumor sites, wherein they mature into effectors to perform their functions, which are enhanced by helper T cells and dampened by Tregs and inhibitory macrophages.

Targeted T Cell Therapy with Engineered T Lymphocytes.

T cell engineering is a groundbreaking strategy to potentially resolve many previously observed shortcomings of earlier immunotherapeutic approaches. Within the past year, researchers have reported dramatic complete remissions in relapsed (Brentjens et al., *Blood* 118, 4817-4828 (2011) and Brentjens et al., *Science translational medicine* 5, 177ra138 (2013)), chemorefractory leukemia and metastatic melanoma (Hunder et al., *N. Engl. J. Med.* 358, 2698-2703 (2008); Rosenberg et al., *Nat. Rev. Cancer* 8, 299-308

(2008); and Dudley et al., *J Clin Oncol* 26, 5233-5239 (2008)), obtained with autologous peripheral blood T cells targeted to a defined antigen (CD19 and NY-ESO-1, respectively).

Rationale for a Genetic Approach:

Cell engineering can be used to redirect T cells toward tumor antigens and to enhance T cell function. One impetus for genetic T cell modification is the potential to enhance T cell survival and expansion and to offset T cell death, anergy, and immune suppression. The genetic targeting of T cells can also be refined to prevent undesired destruction of normal tissues.

Chimeric Antigen Receptors (CARs):

Tumor-specific t cells can be generated by the transfer of genes that encode CARs (Brentjens et al., *Clin. Cancer Res.* 13, 5426-5435 (2007); Gade et al., *Cancer Res.* 65, 9080-9088 (2005); Maher et al., *Nat. Biotechnol.* 20, 70-75 (2002); Kershaw et al., *J Immunol* 173, 2143-2150 (2004); Sadelain et al., *Curr Opin Immunol* (2009); and Hollyman et al., *J Immunother* 32, 169-180 (2009)). Second-generation CARs comprise a tumor antigen-binding domain fused to an intracellular signaling domain capable of activating T cells and a co-stimulatory domain designed to augment T cell potency and persistence (Sadelain et al., *Cancer discovery* 3, 388-398 (2013)). CAR design can therefore reconcile antigen recognition with signal transduction, two functions that are physiologically borne by two separate complexes, the TCR heterodimer and the CD3 complex. The CAR's extracellular antigen-binding domain is usually derived from a murine monoclonal antibody (mAb) or from receptors or their ligands. Antigen recognition is therefore not MHC-restricted (Riviere et al., *Curr Hematol Rep* 3, 290-297 (2004); and Stephan et al., *Nat. Med.* 13, 1440-1449 (2007)) and is therefore applicable to any patient expressing the target antigen, using the same CAR. Antigen binding by the CARs triggers phosphorylation of immunoreceptor tyrosine-based activation motifs (ITAMs) in the intracellular domain, initiating a signaling cascade required for cytolysis induction, cytokine secretion, and proliferation. Because WIC restriction of antigen recognition is bypassed, the function of CAR-targeted T cells is not affected by HLA downregulation or defects in the antigen-processing machinery.

T Cell Requirements for Expansion and Survival:

Proliferation of tumor-specific T cells is needed ex vivo and is arguably desirable in vivo. T cell proliferation must be accompanied by T cell survival to permit absolute T cell expansion and persistence. To proliferate in response to antigen, T cells must receive two signals. One is provided by TCR recognition of antigenic peptide/WIC complexes displayed on the surface of antigen-presenting cells (APCs) (Sadelain et al., *Curr Opin Immunol* (2009)). The other is provided by a T cell co-stimulatory receptor, such as the CD28 or 4-1BB receptors. Whereas the cytolytic activity of T cells does not require concomitant co-stimulation, there is a critical need for the provision of co-stimulatory signals to sustain the antitumor functions of adoptively transferred T cells, as previously demonstrated (Maher et al., *Nat. Biotechnol.* 20, 70-75 (2002); Sadelain et al., *Cancer discovery* 3, 388-398 (2013); Krause et al., *J Exp Med* 188, 619-626 (1998); Gong et al., *Neoplasia.* 1, 123-127 (1999); and Lyddane et al., *J. Immunol.* 176, 3306-3310 (2006)).

Immune Monitoring:

Lymphocytes are multifunctional "drugs" that exhibit dynamically evolving effects after infusion. Upon antigen encounter, tumor-specific T cells activate and/or release a variety of proteins that can trigger tumor killing, T cell proliferation, and recruitment or immunomodulation of other immune cells. Thus, measuring which proteins are secreted from which cells, in what quantity, and at what time point yields profound insights into why a particular patient is or is not responding and provides critical feedback for designing more-effective trials. These assay systems will permit direct and meaningful comparisons of clinical approaches and thus help design rational, next-generation therapeutic strategies.

For treatment, the amount administered is an amount effective in producing the desired effect. An effective amount can be provided in one or a series of administrations. An effective amount can be provided in a bolus or by continuous perfusion.

An "effective amount" (or, "therapeutically effective amount") is an amount sufficient to affect a beneficial or desired clinical result upon treatment. An effective amount can be administered to a subject in one or more doses. In terms of treatment, an effective amount is an amount that is sufficient to palliate, ameliorate, stabilize, reverse or slow the progression of the disease, or otherwise reduce the pathological consequences of the disease. The effective amount is generally determined by the physician on a case-by-case basis and is within the skill of one in the art. Several factors are typically taken into account when determining an appropriate dosage to achieve an effective amount. These factors include age, sex and weight of the subject, the condition being treated, the severity of the condition and the form and effective concentration of the immunoresponsive cells administered.

For adoptive immunotherapy using antigen-specific T cells, cell doses in the range of about $10^6$ to about $10^{10}$ (e.g., about $10^9$) are typically infused. Upon administration of the immunoresponsive cells into the subject and subsequent differentiation, the immunoresponsive cells are induced that are specifically directed against one specific antigen (e.g., FcRL5). "Induction" of T cells can include inactivation of antigen-specific T cells such as by deletion or anergy. Inactivation is particularly useful to establish or reestablish tolerance such as in autoimmune disorders. The immunoresponsive cells of the presently disclosed subject matter can be administered by any methods known in the art, including, but not limited to, pleural administration, intravenous administration, subcutaneous administration, intranodal administration, intratumoral administration, intrathecal administration, intrapleural administration, intraperitoneal administration, and direct administration to the thymus. In certain embodiments, the immunoresponsive cells and the compositions comprising thereof are intravenously administered to the subject in need.

The presently disclosed subject matter provides various methods of using the immunoresponsive cells (e.g., T cells) expressing a FcRL5-specific CAR. For example, the presently disclosed subject matter provides methods of reducing tumor burden in a subject. In one non-limiting example, the method of reducing tumor burden comprises administering an effective amount of the presently disclosed immunoresponsive cell to the subject, thereby inducing tumor cell death in the subject. The presently disclosed immunoresponsive cell can reduce the number of tumor cells, reduce tumor size, and/or eradicate the tumor in the subject. Non-limiting examples of suitable tumors include multiple myeloma, Non-Hodgkin Lymphoma (especially Mantle Cell), Hodgkin Lymphoma, Chronic Lymphocytic Leukemia (CLL), Acute lymphocytic leukemia (ALL), Hairy Cell Leukemia, Burketts Lymphoma, and Waldenstrom's Macroglobulinemia.

The presently disclosed subject matter also provides methods of increasing or lengthening survival of a subject having a neoplasia. In one non-limiting example, the method of increasing or lengthening survival of a subject having neoplasia comprises administering an effective amount of the presently disclosed immunoresponsive cell to the subject, thereby increasing or lengthening survival of the subject. The method can reduce or eradicate tumor burden in the subject. The presently disclosed subject matter further provides methods for treating or preventing a neoplasia in a subject, comprising administering the presently disclosed immunoresponsive cell to the subject.

As used herein, the term "neoplasia" refers to a disease characterized by the pathological proliferation of a cell or tissue and its subsequent migration to or invasion of other tissues or organs. Neoplasia growth is typically uncontrolled and progressive, and occurs under conditions that would not elicit, or would cause cessation of, multiplication of normal cells. Neoplasias can affect a variety of cell types, tissues, or organs, including but not limited to an organ selected from the group consisting of bladder, colon, bone, brain, breast, cartilage, glia, esophagus, fallopian tube, gallbladder, heart, intestines, kidney, liver, lung, lymph node, nervous tissue, ovaries, pleura, pancreas, prostate, skeletal muscle, skin, spinal cord, spleen, stomach, testes, thymus, thyroid, trachea, urogenital tract, ureter, urethra, uterus, and vagina, or a tissue or cell type thereof. Neoplasias include cancers, such as sarcomas, carcinomas, or plasmacytomas (malignant tumor of the plasma cells).

Cancers whose growth may be inhibited using the immunoresponsive cells of the presently disclosed subject matter comprise cancers typically responsive to immunotherapy. Non-limiting examples of cancers for treatment include multiple myeloma, Non-Hodgkin Lymphoma (especially Mantle Cell), Hodgkin Lymphoma, Chronic Lymphocytic Leukemia (CLL), Acute lymphocytic leukemia (ALL), Hairy Cell Leukemia, Burketts Lymphoma, and Waldenstrom's Macroglobulinemia. In certain embodiments, the cancer is multiple myeloma.

Additionally, the presently disclosed subject matter provides methods of increasing immune-activating cytokine production in response to a cancer cell in a subject. In one non-limiting example, the method comprises administering the presently disclosed immunoresponsive cell to the subject. The immune-activating cytokine can be granulocyte macrophage colony stimulating factor (GM-CSF), IFN-α, IFN-β, IFN-γ, TNF-α, IL-2, IL-3, IL-6, IL-11, IL-7, IL-12, IL-15, IL-21, interferon regulatory factor 7 (IRF7), and combinations thereof. In certain embodiments, the immunoresponsive cells including an FcRL5-specific CAR of the presently disclosed subject matter increase the production of GM-CSF, IFN-γ, and/or TNF-α.

Suitable human subjects for therapy typically comprise two treatment groups that can be distinguished by clinical criteria. Subjects with "advanced disease" or "high tumor burden" are those who bear a clinically measurable tumor (e.g., multiple myeloma). A clinically measurable tumor is one that can be detected on the basis of tumor mass (e.g., by palpation, CAT scan, sonogram, mammogram or X-ray; positive biochemical or histopathologic markers on their own are insufficient to identify this population). A pharmaceutical composition embodied in the presently disclosed subject matter is administered to these subjects to elicit an anti-tumor response, with the objective of palliating their condition. Ideally, reduction in tumor mass occurs as a result, but any clinical improvement constitutes a benefit. Clinical improvement comprises decreased risk or rate of progression or reduction in pathological consequences of the tumor (e.g., multiple myeloma).

A second group of suitable subjects is known in the art as the "adjuvant group." These are individuals who have had a history of neoplasia (e.g., multiple myeloma), but have been responsive to another mode of therapy. The prior therapy can have included, but is not restricted to, surgical resection, radiotherapy, and traditional chemotherapy. As a result, these individuals have no clinically measurable tumor. However, they are suspected of being at risk for progression of the disease, either near the original tumor site, or by metastases. This group can be further subdivided into high-risk and low-risk individuals. The subdivision is made on the basis of features observed before or after the initial treatment. These features are known in the clinical arts, and are suitably defined for each different neoplasia. Features typical of high-risk subgroups are those in which the tumor (e.g., multiple myeloma) has invaded neighboring tissues, or who show involvement of lymph nodes. Another group has a genetic predisposition to neoplasia (e.g., multiple myeloma) but has not yet evidenced clinical signs of neoplasia (e.g., multiple myeloma). For instance, women testing positive for a genetic mutation associated with breast cancer, but still of childbearing age, can wish to receive one or more of the antigen-binding fragments described herein in treatment prophylactically to prevent the occurrence of neoplasia until it is suitable to perform preventive surgery.

The subjects can have an advanced form of disease (e.g., multiple myeloma), in which case the treatment objective can include mitigation or reversal of disease progression, and/or amelioration of side effects. The subjects can have a history of the condition, for which they have already been treated, in which case the therapeutic objective will typically include a decrease or delay in the risk of recurrence.

Further modification can be introduced to the FcRL5-specific CAR-expressing immunoresponsive cells (e.g., T cells) to avert or minimize the risks of immunological complications (known as "malignant T-cell transformation"), e.g., graft versus-host disease (GvHD), or when healthy tissues express the same target antigens as the tumor cells, leading to outcomes similar to GvHD. A potential solution to this problem is engineering a suicide gene into the CAR-expressing T cells. Suitable suicide genes include, but are not limited to, Herpes simplex virus thymidine kinase (hsv-tk), inducible Caspase 9 Suicide gene (iCasp-9), and a truncated human epidermal growth factor receptor (EGFRt) polypeptide. In certain embodiments, the suicide gene is an EGFRt polypeptide. The EGFRt polypeptide can enable T cell elimination by administering anti-EGFR monoclonal antibody (e.g., cetuximab). EGFRt can be covalently joined to the 3' terminus of the intracellular domain of the FcRL5-specific CAR. The suicide gene can be included within the vector comprising nucleic acids encoding the presently disclosed FcRL5-specific CARs. In this way, administration of a prodrug designed to activate the suicide gene (e.g., a prodrug (e.g., AP1903 that can activates iCasp-9) during malignant T-cell transformation (e.g., GVHD) triggers apoptosis in the suicide gene-activated CAR-expressing T cells.

IX. Kits

The presently disclosed subject matter provides kits for the treatment or prevention of a neoplasia (e.g., multiple myeloma). In certain embodiments, the kit comprises a therapeutic or prophylactic composition containing an effective amount of an immunoresponsive cell comprising a FcRL5-specific CAR in unit dosage form. In particular embodiments, the cells further expresses at least one co-stimulatory ligand. In certain embodiments, the kit comprises a sterile container which contains a therapeutic or prophylactic vaccine; such containers can be boxes, ampules, bottles, vials, tubes, bags, pouches, blister-packs, or other suitable container forms known in the art. Such containers can be made of plastic, glass, laminated paper, metal foil, or other materials suitable for holding medicaments.

If desired, the immunoresponsive cell is provided together with instructions for administering the cell to a subject having or at risk of developing a neoplasia (e.g., multiple myeloma). The instructions will generally include information about the use of the composition for the treatment or prevention of a neoplasia (e.g., multiple myeloma). In other embodiments, the instructions include at least one of the following: description of the therapeutic agent; dosage schedule and administration for treatment or prevention of a neoplasia (e.g., multiple myeloma) or symptoms thereof; precautions; warnings; indications; counter-indications; overdosage information; adverse reactions; animal pharmacology; clinical studies; and/or references. The instructions may be printed directly on the container (when present), or as a label applied to the container, or as a separate sheet, pamphlet, card, or folder supplied in or with the container.

X. Exemplary Extracellular Antigen-Binding Domains (e.g., scFvs

TABLE 1

ET200-001

DNA Sequence
(light chain variable region scFv linker heavy chain variable region His tag + HA tag)
Cagtctgtgttgacgcagccaccctcagcgtctgggaccccgggcagagggtcaccatctcttgttctggaagcagctccaac
atcggaagtaatactgtaaactggtaccagcagctcccaggaacggccccaaactcctcatctatagtaataatcagcggccct
caggggtccctgaccgattctctggctccaagtctggcacctcagcctccctggccatcagtgggctccagtctgaggatgagg
ctgattattactgtgcagcatgggatgacagcctgaatggttatgtcttcggaactgggaccaaggtcaccgtcctaggt [SEQ ID NO: 1]

<u>tctagaggtggtggtggtagcggcggcggcggctctggtggtggtggatccctcgagatggcc</u> [SEQ ID NO: 305]

**caggtgcagctacagcagtggggcgcaggactgttgaagcttcggagaccctgtccctcacctgcgctgtgtatggtgg
gtccttcagtggttactactggagctggatccgccagcccccagggaaggggctggagtggattggggaaatcaatcat
agtggaagcaccaactacaacccgtccctcaagagtcgagtcaccatatcagtagacacgtccaagaaccagttctccc
tgaagctgagctctgtgaccgccgcggacacggccgtgtattactgtgcgcgcgaaggtccgtacgacggtttcgattctt
ggggtcaaggtactctggtgaccgtctcctca** [SEQ ID NO: 2]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYVFGTGTKVTVL
G [SEQ ID NO: 3]

<u>SRGGGGSGGGGSGGGGSLEMA</u> [SEQ ID NO: 307]

**QVQLQQWGAGLLKPSETLSLTCAVYGGSFSGYYWSWIRQPPGKGLEWIGEI
NHSGSTNYNPSLKSRVTISVDTSKNQFSLKLSSVTAADTAVYYCAREGPYDGF
DSWGQGTLVTVSS** [SEQ ID NO: 4]

TSGQAGQHHHHHHGAYPYDVPDYAS [SEQ ID NO: 308]

TABLE 2

ET200-002

DNA Sequence
(light chain variable region scFv linker heavy chain variable region His tag + HA tag)
Aattttatgctgactcagccccactctgtgtcggagtctccggggaagacggtaaccatctcctgcacccgcagcagtggcagc
attgccagcaactatgtgcagtggtaccagcagcgcccgggcagtgccccaccactgtgatctatgaggataaccaaagacc
ctctggggtccctgatcggttctctggctccatcgacagctcctccaactctgcctccctcaccatctctggactgaagactgagg
acgaggctgactactactgtcagtcttatgatagcagcaattctgtggtattcggcggagggaccaagctgaccgtcctaggt
[SEQ ID No. 5]

<u>tctagaggtggtggtggtagcggcggcggcggctctggtggtggtggatccctcgagatggcc</u> [SEQ ID NO: 305]

**caggtccagctggtacagtctggcactgaggtgaagaagcctggggcctcagtgagggtcgcctgcaaggcttctggtt
accccttaacaaatatgacatcaactgggtgcgacaggcccctggacaagggcttgagtggatgggaggcatcatccc
tatctttcgtacaacaaactacgcacagaagttccagggcagagtcacgattaccgcggacgaatccacgagcacagcc
tacatggagctgagcagcctgagatctgaggacacggccgtatattactgtgcgcgcgaatggttctactgggatatctg
gggtcaaggtactctggtgaccgtctcctca** [SEQ ID NO: 6]

TABLE 2-continued

ET200-002

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSSNSVVFGGGTKLTVLG
[SEQ ID NO: 7]

SRGGGGSGGGGSGGGGSLEMA [SEQ ID NO: 307]

**QVQLVQSGTEVKKPGASVRVACKASGYPFNKYDINWVRQAPGQGLEWMG
GIIPIFRTTNYAQKFQGRVTITADESTSTAYMELSSLRSEDTAVYYCAREWFY
WDIWGQGTLVTVSS** [SEQ ID NO: 8]

TSGQAGQHHHHHHGAYPYDVPDYAS [SEQ ID NO: 308]

TABLE 3

ET200-003

DNA Sequence
(light chain variable region scFv linker heavy chain variable region His tag + HA tag)
cagtctgtgttgactcagccaccctcagtgtccgtgtccccaggacagacagccagcatctcctgctctggaaataaattgggga
ctaagtatgtttactggtatcagaagaggccaggccagtcccctgtgttggtcatgtatgaagataatcagcggccctcagggatc
ccggagcggttctctggctccaactctgggaacacagccactctgaccatcagagggacccagactgtggatgaggctgactat
tactgtcaggcgtgggactccgacacttttcgtggtcttcggcggagggaccaaggtcaccgtcctaggt [SEQ ID NO: 9]

tctagaggtggtggtggtagcggcggcggcggctctggtggtggtggatccctcgagatggcc [SEQ ID NO: 305]

**gaggtgcagctggtggagaccggggggaggcgtggtccagcctgggaggtccctgagactctcctgtgcagcctctggat
tcaccttcagtagttatggcatgcactgggtccgccaggctccaggcaaggggctggagtgggtggcagttatatcacat
gatggaagtaataaatactacgcagactccgtgaagggccgattcaccatctccagagacaattccaaggacacgctgt
atctgcaaatgaacagcctgagaggtgaggacacggccgtatattactgtgcgcgctctaaccagtggtctggttacttct
ctttcgattactggggtcaaggtactctggtgaccgtctcctca** [SEQ ID NO: 10]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSVSVSPGQTASISCSGNKLGTKYVYWYQKRPGQSPVLVMYEDNQRP
SGIPERFSGSNSGNTATLTIRGTQTVDEADYYCQAWDSDTFVVFGGGTKVTVLG
[SEQ ID NO: 11]

SRGGGGSGGGGSGGGGSLEMA [SEQ ID NO: 307]

**EVQLVETGGGVVQPGRSLRLSCAASGFTFSSYGMHWVRQAPGKGLEWVAV
ISHDGSNKYYADSVKGRFTISRDNSKDTLYLQMNSLRGEDTAVYYCARSNQ
WSGYFSFDYWGQGTLVTVSS** [SEQ ID NO: 12]

TSGQAGQHHHHHHGAYPYDVPDYAS [SEQ ID NO: 308]

TABLE 4

ET200-006

DNA Sequence
(light chain variable region scFv linker heavy chain variable region His tag + HA tag)
tcctatgtgctgactcagccaccctcagtgtcagtggccccaggaaagacggccaggattacctgtgggggaaacaacattgga
agtaaaagtgtgcactggtaccagcagaagccaggccaggcccctgtggtggtcatccattatgatagcgaccggccctcagg
gatccctgagcgattctctggctccaactctgggaacacggccaccctgaccatcagcagggtcgaagccggggatgaggcc TABLE 4-continued

ET200-006 gactattactgtcaggtgtgggatagtagtagtgatcatccttatgtcttcggaactgggaccaaggtcaccgtcctaggt [SEQ ID NO: 13]

tctagaggtggtggtggtagcggcggcggcggctctggtggtggtggatccctcgagatggcc [SEQ ID NO: 305]

gaggtgcagctggtgcagtctggagctgaggtgaagaagcctggggcctcagtgaaggtctcctgcaaggcttctggtt
acacctttaccacctatggtatcagctgggtgcgacaggcccctggacaagggcttgagtggatgggatggatcaacac
ttacaatggtcacacaaactatgcacagaagctccagggcagagccacaatgaccgcagacacatccacgaacacag
cctacatggagctgaggagcctgagatctgacgacactgccgtgtattactgtgcgcgcgttatctacggttctggtgatt
actggggtcaaggtactctggtgaccgtctcctca [SEQ ID NO: 14]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
SYVLTQPPSVSVAPGKTARITCGGNNIGSKSVHWYQQKPGQAPVVVIHYDSDRP
SGIPERFSGSNSGNTATLTISRVEAGDEADYYCQVWDSSSDHPYVFGTGTKVTVL
G [SEQ ID NO: 15]

SRGGGGSGGGGSGGGGSLEMA [SEQ ID NO: 307]

**EVQLVQSGAEVKKPGASVKVSCKASGYTFTTYGISWVRQAPGQGLEWMG
WINTYNGHTNYAQKLQGRATMTADTSTNTAYMELRSLRSDDTAVYYCARV
IYGSGDYWGQGTLVTVSS** [SEQ ID NO: 16]

TSGQAGQHHHHHHGAYPYDVPDYAS [SEQ ID NO: 308]

TABLE 5

ET200-007

DNA Sequence
(light chain variable region scFv linker heavy chain variable region His tag + HA tag)
tcctatgtgctgactcagccactctcagtgtcagtggccccaggaaagacggccaggattacctgtgggggaaacaacattgga
agtaaaactgtgcactggtaccagcagaagccaggccaggcccctgtgctggtcatctattatgatagcgaccgccctcaggg
atccctgagcgattctctggctccaactctgggaacacggccacccctgaccatcagcagggtcgaagccggggatgaggcg
actattactgtcaggtgtgggatagtagtagtgatcatcgggtgttcggcggagggaccaagctgaccgtcctaggt [SEQ ID NO: 17]

tctagaggtggtggtggtagcggcggcggcggctctggtggtggtggatccctcgagatggcc [SEQ ID NO: 305]

**caggtgcagctgcaggagtcgggcccaggactggtgaagccttcggagaccctgtccctcacctgcaatgtctctggtta
ctccatcagcagtggttactttttggggctggatccggcagccccagggaaggggctggagtggattgggagtatctatc
atagtaggagcacctactacaacccgtccctcaagagtcgagtcaccatatcagtagacacgtccaagaaccagttctc
cctgaagctgaactctgtgaccgccgcagacacggccgtgtattactgtgcgcgcggttacggttacttcgattactgggg
tcaaggtactctggtgaccgtctcctca** [SEQ ID NO: 18]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence (light chain variable region scFv linker heavy chain variable region His tag + HA tag)
SYVLTQPLSVSVAPGKTARITCGGNNIGSKTVHWYQQKPGQAPVLVIYYDSDRP
SGIPERFSGSNSGNTATLTISRVEAGDEADYYCQVWDSSSDHRVFGGGTKLTVLG
[SEQ ID NO: 19]

SRGGGGSGGGGSGGGGSLEMA [SEQ ID NO: 307]

**QVQLQESGPGLVKPSETLSLTCNVSGYSISSGYFWGWIRQPPGKGLEWIGSI
YHSRSTYYNPSLKSRVTISVDTSKNQFSLKLNSVTAADTAVYYCARGYGYFD
YWGQGTLVTVSS** [SEQ ID NO: 20]

TSGQAGQHHHHHHGAYPYDVPDYAS [SEQ ID NO: 308]

TABLE 6

ET200-008

DNA Sequence
(light chain variable region scFv linker heavy chain variable region His tag + HA tag)
caatctgccctgactcagcctgcctccgtgtctgggtctcctggacagtcgatcaccatctcctgcactggaaccagcagtgacgt
tggtggttataactatgtctcctggtaccaacaacacccaggcaaagcccccaaactcatgatttatgatgtcagtaatcggccctc
aggggtttctaatcgcttctctggctccaagtctggcaacacggcctccctgaccatctctgggctccaggctgaggacgaggct
gattattactgcagctcatatacaagcagcagcacttcgaaggtgttcggcggagggaccaagctgaccgtcctaggt [SEQ
ID NO: 21]

<u>tctagaggtggtggtggtagcggcggcggcggctctggtggtggtggatccctcgagatggcc</u> [SEQ ID NO: 305]

**gaggtgcagctggtggagtctgggggaggtgtggtacggcctggggggtccctgagactctcctgtgcagcctctggatt
cacctttggtgattatggcatgagctgggtccgccaagctccagggaaggggctggagtgggtctctggtattaattgga
atggtggtagcacaggttatgcagactctgtgaagggccgattcaccatctccagagacaacgccaagaactccctgtat
ctgcaaatgaacagtctgagagccgaggacacggccgtatattactgtgcgcgctctaaatacaacttccatgtttactac
gattactggggtcaaggtactctggtgaccgtctcctca** [SEQ ID NO: 22]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSALTQPASVSGSPGQSITISCTGTSSDVGGYNYVSWYQQHPGKAPKLMIYDVSN
RPSGVSNRFSGSKSGNTASLTISGLQAEDEADYYCSSYTSSSTSKVFGGGTKLTVL
G [SEQ ID NO: 23]

<u>SRGGGGSGGGGSGGGGSLEMA</u> [SEQ ID NO: 307]

**EVQLVESGGGVVRPGGSLRLSCAASGFTFGDYGMSWVRQAPGKGLEWVSG
INWNGGSTGYADSVKGRFTISRDNAKNSLYLQMNSLRAEDTAVYYCARSKY
NFHVYYDYWGQGTLVTVSS** [SEQ ID NO: 24]

TSGQAGQHHHHHGAYPYDVPDYAS [SEQ ID NO: 308]

TABLE 7

ET200-009

DNA Sequence
(light chain variable region scFv linker heavy chain variable region His tag + HA tag)
cagtctgtgttgacgcagccaccctcagcgtctgggaccccggggcagacagtcaccatctcttgttctggaagcaactccaac
atcggaagtaattatgtatactggtaccagcagctcccaggaacggccccaaactcctcatctataggaataatcagcggccct
caggggtccctgaccgattctcaggctccaagtctggcacctcagcctcctggccatcagtgggctccgctccgaggatgag
gctgattattactgtgcagcatgggatgacagcctgagtgcttatgtcttcggaactgggaccaaggtcaccgtcctaggt
[SEQ ID NO: 25]

<u>tctagaggtggtggtggtagcggcggcggcggctctggtggtggtggatccctcgagatggcc</u> [SEQ ID NO: 305]

**caggtgcagctggtgcagtctggagctgaggtgaagaagcctggggcctcagtgaaggtctcctgcaaggcttctggtt
acacctttaccagctatggtatcagctgggtgcgacaggcccctggacaagggcttgagtggatgggatggatcagcgc
ttacaatggtaacacaaactatgcacagaagctccagggcagagtcaccatgaccacagacacatccacgagcacagc
ctacatggagctgaggagcctgagatctgacgacactgccgtgtattactgtgcgcgctcttctggtaacatggtttcttgg
aaagatatgtggggtcaaggtactctggtgaccgtctcctca** [SEQ ID NO: 26]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSASGTPGQTVTISCSGSNSNIGSNYVYWYQQLPGTAPKLLIYRNNQR
PSGVPDRFSGSKSGTSASLAISGLRSEDEADYYCAAWDDSLSAYVFGTGTKVTVL
G [SEQ ID NO: 27]

<u>SRGGGGSGGGGSGGGGSLEMA</u> [SEQ ID NO: 307]

**QVQLVQSGAEVKKPGASVKVSCKASGYTFTSYGISWVRQAPGQGLEWMG
WISAYNGNTNYAQKLQGRVTMTTDTSTSTAYMELRSLRSDDTAVYYCARSS
GNMVSWKDMWGQGTLVTVSS** [SEQ ID NO: 28]

TSGQAGQHHHHHGAYPYDVPDYAS [SEQ ID NO: 308]

TABLE 8

ET200-010

DNA Sequence
(light chain variable region scFv linker heavy chain variable region His tag + HA tag)
caatctgccctgactcagcctgcctccgtgtctgggtctcctggacagtcgatcaccatctcctgcactggaaccagcagtgacgt
tggtggttataactctgtctcctggtaccaacaacacccaggcaaagccccccagactcatgatttatgatgtcagtaatcggccctc
aggggtttctaatcgcttctctggctccaagtctggcaacacggcctccctgaccatctctgggctccaggctgaggacgaggct
gattattactgcagctcatatacaagcagcagcacccctttagtcttcggaactgggaccaaggtcaccgtcctaggt [SEQ
ID NO: 29]

<u>tctagaggtggtggtggtagcggcggcggcggctctggtggtggtggatccctcgagatggcc</u> [SEQ ID NO: 305]

**caggtgcagctggtgcagtctggggctgaggtgaagaagcctggggcctcagtgaaggtctcctgcaaggcttctggtt
acacctttaccagctatggtatcagctgggtgcgacaggcccctggacaagggcttgagtggatgggatggatcagcgc
ttacaatggtaacacaaactatgcacagaagctccagggcagagtcaccatgaccacagacacatccacgagcacagc
ctacatggagctgaggagcctgagatctgacgacacggccgtgtattactgtgcgcgcggtgctgttgcttaccatgattg
gggtcaaggtactctggtgaccgtctcctca** [SEQ ID NO: 30]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSALTQPASVSGSPGQSITISCTGTSSDVGGYNSVSWYQQHPGKAPRLMIYDVSN
RPSGVSNRFSGSKSGNTASLTISGLQAEDEADYYCSSYTSSSTPLVFGTGTKVTVL
G [SEQ ID NO: 31]

<u>SRGGGGSGGGGSGGGGSLEMA</u> [SEQ ID NO: 307]

**QVQLVQSGAEVKKPGASVKVSCKASGYTFTSYGISWVRQAPGQGLEWMG
WISAYNGNTNYAQKLQGRVTMTTDTSTSTAYMELRSLRSDDTAVYYCARG
AVAYHDWGQGTLVTVSS** [SEQ ID NO: 32]

TSGQAGQHHHHHHGAYPYDVPDYAS [SEQ ID NO: 308]

TABLE 9

ET200-011

DNA Sequence
(light chain variable region scFv linker heavy chain variable region His tag + HA tag)
cagtctgtcgtgacgcagccgccctcagtgtctgcggccccaggacagagggtcaccatctcctgctctggaagcagctccaa
catttcgatttatgatgtatcctggtatcagcagctcccaggaacagcccccaaactcctcatttatggcaataataagcgaccctc
ggggattgctgaccgattctctggctccacgtctggcacgtcagccaccctgggcatcaccggactccagactggggacgagg
ccgattattactgcggaacatgggatgacagtctgagtggggggggtgttcggcggagggaccaagctgaccgtcctaggt
[SEQ ID NO: 33]

<u>tctagaggtggtggtggtagcggcggcggcggctctggtggtggtggatccctcgagatggcc</u> [SEQ ID NO: 305]

**cagatgcagctggtgcaatctggggctgaggtgaagaagcctgggtcctcggtgaaggtctcctgcgaggcttctggag
gcacccctcagcagctatgctatcaactgggtgcgacaggcccctggacaagggcttgagtggatgggagggatcatccc
tatgtttggtacagcacactacgcacagaagttccagggcagagtcacgattaccgcggacgaatccacgaaaacagc
ctacatggagctgagcagcctgagatctgaggacactgccgtgtattactgtgcgcgcggtgttcattacgcttctttcgat
cattggggtcaaggtactctggtgaccgtctcctca** [SEQ ID NO: 34]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVVTQPPSVSAAPGQRVTISCSGSSSNISIYDVSWYQQLPGTAPKLLIYGNNKRP
SGIADRFSGSTSGTSATLGITGLQTGDEADYYCGTWDDSLSGGVFGGGTKLTVLG
[SEQ ID NO: 35]

<u>SRGGGGSGGGGSGGGGSLEMA</u> [SEQ ID NO: 307]

**QMQLVQSGAEVKKPGSSVKVSCEASGGTLSSYAINWVRQAPGQGLEWMGG
IIPMFGTAHYAQKFQGRVTITADESTKTAYMELSSLRSEDTAVYYCARGVHY
ASFDHWGQGTLVTVSS** [SEQ ID NO: 36]

TSGQAGQHHHHHHGAYPYDVPDYAS [SEQ ID NO: 308]

TABLE 10

ET200-012

DNA Sequence
(light chain variable region scFv linker heavy chain variable region His tag + HA tag)
cagtctgtgttgacgcagccgccctcagtgtctgcggccgcaggacagaaggtcaccatctcctgctctggaagcgactccaac
attgggaataattatgtgtcctggtatcaacacctcccagggacagcccccaaactcctcatttatgacgttaaaaatcgaccctca
gggattcctgaccggttctccggctccaagtctggctcgtcagccacccctaggcatcgccggactccagcctggggacgaggc
cgattattactgcggaacatgggacagtcggctgatgcctatgtcttcggaactgggaccaaggtcaccgtcctaggt [SEQ
ID NO: 37]

<u>tctagaggtggtggtggtagcggcggcggcggctctggtggtggtggatccctcgagatggcc</u> [SEQ ID NO: 305]

**cagatgcagctggtgcaatctggagctgaggtgaagaagcctggggcctcagtgaaggtctcctgcaagacttctggtttt
ccctttaatatctttggaatcacctgggtgcgacaggcccctggacaagggcttgagtggatgggatggatcagcggtt
acaacggtaacacagactaccacagaagttccagggcagagtcaccatgtccacagacacatccacgagtacagcct
acatggagctgaggaacctgaaatctgacgacacggccgtgtattactgtgcgcgcggtgcttacggtggtatggatact
tggggtcaaggtactctggtgaccgtctcctca** [SEQ ID NO: 38]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSVSAAAGQKVTISCSGSDSNIGNNYVSWYQHLPGTAPKLLIYDVKNR
PSGIPDRFSGSKSGSSATLGIAGLQPGDEADYYCGTWDSRLDAYVFGTGTKVTVL
G [SEQ ID NO: 39]

<u>SRGGGGSGGGGSGGGGSLEMA</u> [SEQ ID NO: 307]

**QMQLVQSGAEVKKPGASVKVSCKTSGFPFNIFGITWVRQAPGQGLEWMGW
ISGYNGNTDYPQKFQGRVTMSTDTSTSTAYMELRNLKSDDTAVYYCARGAY
GGMDTWGQGTLVTVSS** [SEQ ID NO: 40]

TSGQAGQHHHHHHGAYPYDVPDYAS [SEQ ID NO: 308]

TABLE 11

ET200-013

DNA Sequence
(light chain variable region scFv linker heavy chain variable region His tag + HA tag)
cagtctgtcgtgacgcagccgccctcagtgtctggggccccagggcagagggtcaccatctcctgcactgggagcacctccaa
catcggggcaggttatgatgtacactggtatcagcagcttccaggaacagcccccaaactcctcatctatactaacaactttcggc
cctcaggggtccctgaccgattctctgcctccaagtctggcacttcagcttcctggccatcactggtctccaggctgaggatgag
gctgattattactgcggaacatgggatagcagcctgagtgccgttgtgttcggcggagggaccaagctgaccgtcctaggt
[SEQ ID NO: 41]

<u>tctagaggtggtggtggtagcggcggcggcggctctggtggtggtggatccctcgagatggcc</u> [SEQ ID NO: 305]

**gaggtgcagctggtggagtctggaactgaggtgaagaagcctggggcctcagtgaaagtctcctgcaaggcttctggtt
acatgtttaccagttatggtctcaactgggtgcgacaggcccctggacaagggcttgagtggatgggatggatcagcgct
aacaatggtaagacaaattatgctaagaaattccaggacagagtcaccatgaccagagacacttccacgagcacaggc
tacatgaactgaggagcctgagatctgacgacacggccgtatattactgtgcgcgccatatcggtggttcttacttcgat
cgttggggtcaaggtactctggtgaccgtctcctca** [SEQ ID NO: 42]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVVTQPPSVSGAPGQRVTISCTGSTSNIGAGYDVHWYQQLPGTAPKLLIYTNNF
RPSGVPDRFSASKSGTSASLAITGLQAEDEADYYCGTWDSSLSAVVFGGGTKLT
VLG [SEQ ID NO: 43]

<u>SRGGGGSGGGGSGGGGSLEMA</u> [SEQ ID NO: 307]

**EVQLVESGTEVKKPGASVKVSCKASGYMFTSYGLNWVRQAPGQGLEWMG
WISANNGKTNYAKKFQDRVTMTRDTSTSTGYMELRSLRSDDTAVYYCARHI
GGSYFDRWGQGTLVTVSS** [SEQ ID NO: 44]

TSGQAGQHHHHHHGAYPYDVPDYAS [SEQ ID NO: 308]

TABLE 12

ET200-014

DNA Sequence
(light chain variable region scFv linker heavy chain variable region His tag + HA tag)
tcctatgtgctgactcagccaccctcagtgtcagtggccccaggaaagacggccaggattacctgtgggggaaacaacattgga
agtaaaagtgtgcactggtaccagcagaagccaggccaggcccctgtgctggtcatctattatgatagcgaccggccctcagg
gatccctgagcgattctctggctccaactctgggaacacggccaccctgaccatcagcagggtcgaagccggggatgaggcc
gactattactgtcaggtgtgggatagtagtagtgatcattatgtcttcggaactgggaccaaggtcaccgtcctaggt [SEQ ID
NO: 45]

<u>tctagaggtggtggtggtagcggcggcggcggctctggtggtggtggatccctcgagatggcc</u> [SEQ ID NO: 305]

**gaggtgcagctggtggagactgggggaggcttggtacagcctggggggtccctgagactctcctgtgcagcctctggatt
cacctttagcagctatgccatgagctgggtccgccaggctccagggaaggggctggagtgggtctcagctattagtggta
gtgatggtagcacatactacgcagactccgtgaagggccggttcaccatctccagagacaattccaagaacacgctgta
tctgcaaatgaacagcctgagagacgaggacacggccgtatattactgtgcgcgctctcatgaagctaacctggttggtg
attggtggggtcaaggtactctggtgaccgtctcctca** [SEQ ID NO: 46]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
SYVLTQPPSVSVAPGKTARITCGGNNIGSKSVHWYQQKPGQAPVLVIYYDSDRPS
GIPERFSGSNSGNTATLTISRVEAGDEADYYCQVWDSSSDHYVFGTGTKVTVLG
[SEQ ID NO: 47]

<u>SRGGGGSGGGGSGGGGSLEMA</u> [SEQ ID NO: 307]

**EVQLVETGGGLVQPGGSLRLSCAASGFTFSSYAMSWVRQAPGKGLEWVSAI
SGSDGSTYYADSVKGRFTISRDNSKNTLYLQMNSLRDEDTAVYYCARSHEAN
LVGDWWGQGTLVTVSS** [SEQ ID NO: 48]

TSGQAGQHHHHHGAYPYDVPDYAS [SEQ ID NO: 308]

TABLE 13

ET200-015

DNA Sequence
(light chain variable region scFv linker heavy chain variable region His tag + HA tag)
cagtctgtggtgactcagccaccctcagtgtcagtggccccaggaaagacggccaggattacctgtgggggaaacaacattgg
aagtaaaagtgtgcactggtaccagcagaagccaggccaggcccctgtgctggtcatctattatgatagcgaccggccctcagg
gatccctgagcgattctctggctccaactctgggaacacggccaccctgaccatcagcagggtcgaagccggggatgaggcc
gactattactgtcaggtgtgggatagtagtagtgatgtggtattcggcggagggaccaagctgaccgtcctaggt [SEQ ID
NO: 49]

<u>tctagaggtggtggtggtagcggcggcggcggctctggtggtggtggatccctcgagatggcc</u> [SEQ ID NO: 305]

**gaggtccagctggtacagtctggagctgaggtgaagaagcctggggcctcagtgaaggtctcctgcaaggcttctggtt
acacctttaccagctacggtatcagctgggtgcgacaggcccctggacaagggcttgagtggatgggatggatcagcgc
ttacaatggtaacacaaactatgcacagaagctccagggcagagtcaccatgaccacagacacatccacgagcacagc
ctacatggagctgaggagcctgagatctgacgacacggccgtgtattactgtgcgcgctggggtggtttcggtgctgttg
atcattggggtcaaggtactctggtgaccgtctcctca** [SEQ ID NO: 50]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVVTQPPSVSVAPGKTARITCGGNNIGSKSVHWYQQKPGQAPVLVIYYDSDRP
SGIPERFSGSNSGNTATLTISRVEAGDEADYYCQVWDSSSDVVFGGGTKLTVLG
[SEQ ID NO: 51]

<u>SRGGGGSGGGGSGGGGSLEMA</u> [SEQ ID NO: 307]

**EVQLVQSGAEVKKPGASVKVSCKASGYTFTSYGISWVRQAPGQGLEWMGW
ISAYNGNTNYAQKLQGRVTMTTDTSTSTAYMELRSLRSDDTAVYYCARWG
GFGAVDHWGQGTLVTVSS** [SEQ ID NO: 52]

TSGQAGQHHHHHGAYPYDVPDYAS [SEQ ID NO: 308]

TABLE 14

ET200-016

DNA Sequence
(light chain variable region scFv linker heavy chain variable region His tag + HA tag)
tcttctgagctgactcaggaccctgctgtgtctgtggccttgggacagacagtcaagatcacgtgccaaggagacagcctcaca
gactaccatgcaacctggtaccagcagaagccaggacaggccccgtcgctgtcatctatgctacaaacaaccggcccactgg
gatcccagaccgattctctggttccagttccggaaacacagcttctttgaccatcactggggctcaggcggaagatgaggctgac
tattactgtaattcccgggacagcggcacggacgaagtgttattcggcggagggaccaagctgaccgtcctaggt [SEQ ID
NO: 53]

<u>tctagaggtggtggtggtagcggcggcggcggctctggtggtggtggatccctcgagatggcc</u> [SEQ ID NO: 305]

**gaggtgcagctggtggagactgggggaggcctggtcaagcctggggggtccctgagactctcctgtgcagcctctggat
tcaccttcagtagctatagcatgaactgggtccgccaggctccagggaaggggctggagtgggtctcatccattagtagt
agtagtagttacatatactacgcagactcagtgaaggggccgattcaccatctccagagacaacgccaagaactcactgt
atctgcaaatgaacagcctgagagccgaggacacggccgtgtattactgtgcgcgcggtcagggttacgattactgggg
tcaaggtactctggtgaccgtctcctca** [SEQ ID NO: 54]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
SSELTQDPAVSVALGQTVKITCQGDSLTDYHATWYQQKPGQAPVAVIYATNNRP
TGIPDRFSGSSSGNTASLTITGAQAEDEADYYCNSRDSGTDEVLFGGGTKLTVLG
[SEQ ID NO: 55]

<u>SRGGGGSGGGGSGGGGSLEMA</u> [SEQ ID NO: 307]

**EVQLVETGGGLVKPGGSLRLSCAASGFTFSSYSMNWVRQAPGKGLEWVSSI
SSSSSYIYYADSVKGRFTISRDNAKNSLYLQMNSLRAEDTAVYYCARGQGYD
YWGQGTLVTVSS** [SEQ ID NO: 56]

TSGQAGQHHHHHGAYPYDVPDYAS [SEQ ID NO: 308]

TABLE 15

ET200-017

DNA Sequence
(light chain variable region scFv linker heavy chain variable region His tag + HA tag)
tcctatgtgctgactcagccaccctcggtgtcagtggccccaggaaagacggccaggattacctgtgggggaaacaacattgg
aagtaaaagtgtgcactggtaccagcagaagccaggccaggcccctgtgctggtcgtctatgatgatagcgaccggccctcag
ggatccctgagcgattctctggctccaactctgggaacacggccaccctgagcatcagcagggtcgaagccggggatgaggc
cgactattactgtcaggtgtgggatagtagtagtgatcatactgtcttcggaactgggaccaaggtcaccgtcctaggt [SEQ
ID NO: 57]

<u>tctagaggtggtggtggtagcggcggcggcggctctggtggtggtggatccctcgagatggcc</u> [SEQ ID NO: 305]

**caggtgcagctacagcagtggggcgcaggactgttgaagccttcggagaccctgtccctcacctgcgctgtctatggtgg
gtccttcagtggttactactggagctggatccgccagcccccagggaaggggctggagtggattggggaaatcaatcat
agtggaagcaccaactacaacccgtccctcaagagtcgagtcaccatatcagtagacacgtccaagaaccagttctccc
tgaagctgagctctgtgaccgccgcggacacggccgtgtattactgtgcgcgctactacccgggtatggatatgggggt
caaggtactctggtgaccgtctcctca** [SEQ ID NO: 58]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
SYVLTQPPSVSVAPGKTARITCGGNNIGSKSVHWYQQKPGQAPVLVVYDDSDRP
SGIPERFSGSNSGNTATLSISRVEAGDEADYYCQVWDSSSDHTVFGTGTKVTVLG
[SEQ ID NO: 59]

<u>SRGGGGSGGGGSGGGGSLEMA</u> [SEQ ID NO: 307]

**QVQLQQWGAGLLKPSETLSLTCAVYGGSFSGYYWSWIRQPPGKGLEWIGEI
NHSGSTNYNPSLKSRVTISVDTSKNQFSLKLSSVTAADTAVYYCARYYPGMD
MWGQGTLVTVSS** [SEQ ID NO: 60]

TSGQAGQHHHHHGAYPYDVPDYAS [SEQ ID NO: 308]

TABLE 16

ET200-018

DNA Sequence
(light chain variable region scFv linker heavy chain variable region His tag + HA tag)
caggctgtgctgactcagccgccctcaacgtctgggaccccgggcagagggtcaccatctcttgttctggaagcagctccaac
atcgggagaaatggtgtaaactggtaccagcagctcccaggagcggcccccaaagtcctcatctataatgataatcagcgaccc
tcaggggtccctgaccgagtctctggctcccagtctggctcctcaggcaccctggccatcgatgggcttcggtctgaggatgag
gctgattattactgtgcggcatgggatgacagcctgcatggtgtggtattcggcggagggaccaagctgaccgtcctaggt
[SEQ ID NO: 61]

<u>tctagaggtggtggtggtagcggcggcggcggctctggtggtggtggatccctcgagatggcc</u> [SEQ ID NO: 305]

**caggtccagctggtacagtctggggctgaggtgaagaagcctggggcctcagtgaaggtctcctgcaaggtttccggat
acaccctcaatgaattatccatgcactgggtgcgacaggctcctggaaaagggcttgagtggatgggaggttttgatcct
gaagatggtgaaacaatctacgcacagaagttccagggcagagtcaccatgaccgaggacacatctacagacacagc
ctacatggagctgagcagcctgagatctgaggacactgccgtgtattactgtgcgcgcggtggttacggtgattcttggg
gtcaaggtactctggtgaccgtctcctca** [SEQ ID NO: 62]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QAVLTQPPSTSGTPGQRVTISCSGSSSNIGRNGVNWYQQLPGAAPKVLIYNDNQR
PSGVPDRVSGSQSGSSGTLAIDGLRSEDEADYYCAAWDDSLHGVVFGGGTKLTV
LG [SEQ ID NO: 63]

<u>SRGGGGSGGGGSGGGGSLEMA</u> [SEQ ID NO: 307]

**QVQLVQSGAEVKKPGASVKVSCKVSGYTLNELSMHWVRQAPGKGLEWMG
GFDPEDGETIYAQKFQGRVTMTEDTSTDTAYMELSSLRSEDTAVYYCARGG
YGDSWGQGTLVTVSS** [SEQ ID NO: 64]

TSGQAGQHHHHHHGAYPYDVPDYAS [SEQ ID NO: 308]

TABLE 17

ET200-019

DNA Sequence
(light chain variable region scFv linker heavy chain variable region His tag + HA tag)
aattttatgctgactcagccccactctgtgtcggagtctccggggaagacggtaaccatctcctgcacccgcagcagtggcagca
ttgccagcaactatgtgcagtggtaccagcagcgcccgggcagtgccccaccactgtgatctatgaggataaccaaagaccct
ctggggtccctgatcggttctctggctccatcgacagctcctccaactctgctcctcaccatctctggactgaagactgaggac
gaggctgactactactgtcagtcttatgatagcagcaattcttgggtgttcggcggagggaccaagctgaccgtcctaggt
[SEQ ID NO: 65]

<u>tctagaggtggtggtggtagcggcggcggcggctctggtggtggtggatccctcgagatggcc</u> [SEQ ID NO: 305]

**caggtgcagctggtgcaatctggggctgaggtgaagaggcctgggtcctcggtgaaggtctcctgcacggcttctggag
gcaccttcagcagcgatgctatcagctgggtgcgacaggcccctggacaagggcttgagtggatgggaggaatcatccc
tatgtttggtacagcaaactacgcacagaagttccagggcagagtcacgattaccgcggacgaatccacgagcacagc
ctacatggagctgagcagcctgagatctgaggacacggccgtgtattactgtgcgcgcgaaggttactactacccgtctg
cttacctgggttctgttctgaacgacatctcttctgtttacgatgaatggggtcaaggtactctggtgaccgtctcctca**
[SEQ ID NO: 66]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSSNSWVFGGGTKLTVL
G [SEQ ID NO: 67]

<u>SRGGGGSGGGGSGGGGSLEMA</u> [SEQ ID NO: 307]

**QVQLVQSGAEVKRPGSSVKVSCTASGGTFSSDAISWVRQAPGQGLEWMGGI
IPMFGTANYAQKFQGRVTITADESTSTAYMELSSLRSEDTAVYYCAREGYYY
PSAYLGSVLNDISSVYDEWGQGTLVTVSS** [SEQ ID NO: 68]

TSGQAGQHHHHHHGAYPYDVPDYAS [SEQ ID NO: 308]

TABLE 18

ET200-020

DNA Sequence
(light chain variable region scFv linker heavy chain variable region His tag + HA tag)
cagtctgtcgtgacgcagccgccctcagtgtctgcggccccaggacagaaggtcaccatctcctgctctggaagcacctccaac
attggaaataatgatgtatcctggtaccagcagcccccaggaacagcccccaaactcctcatttatgacaataataagcgaccctc
agggattcctgaccgattctctggctccaagtctggcacgtcagccaccctgggcatcaccggactccagactggggacgagg
ccgattattactgcggaacatgggatagcagcgtgagtgcttcttgggtcttcggcagagggaccaagctgaccgtcctaggt
[SEQ ID NO: 69]

<u>tctagaggtggtggtggtagcggcggcggcggctctggtggtggtggatccctcgagatggcc</u> [SEQ ID NO: 305]

**caggtgcagctggtgcagtctggagctgaggtgaagaagcctggggcctcagtgaaggtctcctgcaaggcttctggtt
acacctttaccagctatggtatcagctgggtgcgacaggcccctggacaagggcttgagtggatgggatggatcagcgc
ttacaatggtaacacaaactatccacagaagctccagggcagagtcaccatgaccacagacccatccacgagcacagc
ctacatggagctgaggagcctgagatctgacgacacggccgtgtattactgtgcgcgctctatgacttctttcgattactg
gggtcaaggtactctggtgaccgtctcctca** [SEQ ID NO: 70]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVVTQPPSVSAAPGQKVTISCSGSTSNIGNNDVSWYQQLPGTAPKLLIYDNNKR
PSGIPDRFSGSKSGTSATLGITGLQTGDEADYYCGTWDSSVSASWVFGRGTKLTV
LG [SEQ ID NO: 71]

<u>SRGGGGSGGGGSGGGGSLEMA</u> [SEQ ID NO: 307]

**QVQLVQSGAEVKKPGASVKVSCKASGYTFTSYGISWVRQAPGQGLEWMG
WISAYNGNTNYPQKLQGRVTMTTDPSTSTAYMELRSLRSDDTAVYYCARSM
TSFDYWGQGTLVTVSS** [SEQ ID NO: 72]

TSGQAGQHHHHHGAYPYDVPDYAS [SEQ ID NO: 308]

TABLE 19

ET200-021

DNA Sequence
(light chain variable region scFv linker heavy chain variable region His tag + HA tag)
cagtctgtgttgacgcagccgccctcagtgtctgcggccccaggacagaaggtcaccatctcctgctctggaagcaactccaac
attgggaataattatgtatcctggtatcagcaactcccagggacagcccccaaactcctcatttatgacaataataagcgaccctca
gggattcctgaccgattctctggctccaggtctggcacgtcagccaccctgggcatcaccggactccagactggggacgaggc
cgattattactgcggaacatggaataccactgtgactcctggctatgtcttcggaactgggaccaaggtcaccgtcctaggt
[SEQ ID NO: 73]

<u>tctagaggtggtggtggtagcggcggcggcggctctggtggtggtggatccctcgagatggcc</u> [SEQ ID NO: 305]

**gaagtgcagctggtgcagtctggagctgaggtgaagaagcctggggcctcagtgaaggtctcctgcaaggcttctggtt
acacctttaccagctatggtatcagctgggtgcgacaggcccctggacaagggcttgagtggatgggatggatcagcgc
ttacaatggtaacacaaactatgcacagaagctccagggcagagtcaccatgaccacagacacatccacgagcacagc
ctacatggagctgaggagcctgagatctgacgacaccgccatgtattactgtgcgcgctctgtttacgacctggatacttg
gggtcaaggtactctggtgaccgtctcctca** [SEQ ID NO: 74]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSVSAAPGQKVTISCSGSNSNIGNNYVSWYQQLPGTAPKLLIYDNNKR
PSGIPDRFSGSRSGTSATLGITGLQTGDEADYYCGTWNTTVTPGYVFGTGTKVTV
LG [SEQ ID NO: 75]

<u>SRGGGGSGGGGSGGGGSLEMA</u> [SEQ ID NO: 307]

**EVQLVQSGAEVKKPGASVKVSCKASGYTFTSYGISWVRQAPGQGLEWMGW
ISAYNGNTNYAQKLQGRVTMTTDTSTSTAYMELRSLRSDDTAMYYCARSVY
DLDTWGQGTLVTVSS** [SEQ ID NO: 76]

TSGQAGQHHHHHGAYPYDVPDYAS [SEQ ID NO: 308]

141

142

TABLE 20

ET200-022

DNA Sequence
(light chain variable region scFv linker heavy chain variable region His tag + HA tag)
cagtctgtcgtgacgcagccgccctcagtgtctgcggcccaggacagaaggtcaccatctcctgctctggaagcagctccaa
cattgggaataattatgtatcctggtaccagcagctcccaggaacagcccccaaactcctcatttatgacaataataagcgaccct
cagggattcctgaccgattctctggctccaagtctggcacgtcagccaccctgggcatcaccggactccagactggggacgag
gccgattattactgcgggaacatgggatagcagcctgggggccccttatgtcttcggaactgggaccaaggtcaccgtcctaggt
[SEQ ID NO: 77]

<u>tctagaggtggtggtggtagcggcggcggcggctctggtggtggtggatccctcgagatggcc</u> [SEQ ID NO: 305]

**gaggtgcagctggtgcagtctggggaggctcggaacagcctggcaggtccctgagactctcctgtgcagcctctggatt
cacctttgatgattatgccatgcactgggtccggcaagctccagggaagggcctggagtgggtctcaggtattagttgga
atagcggtagcataggctatgcggactctgtgaagggccgattcaccatctccagagacaacgccaagaattccctgtat
ctgcaaatgaacagtctgagagctgaggacaccgccatgtattactgtgcgcgctaccgtcaggttggttctgcttacgat
tcttggggtcaaggtactctggtaccgtctcctca** [SEQ ID NO: 78]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVVTQPPSVSAAPGQKVTISCSGSSSNIGNNYVSWYQQLPGTAPKLLIYDNNKR
PSGIPDRFSGSKSGTSATLGITGLQTGDEADYYCGTWDSSLGAPYVFGTGTKVTV
LG [SEQ ID NO: 79]

<u>SRGGGGSGGGGSGGGGSLEMA</u> [SEQ ID NO: 307]

**EVQLVQSWGGSEQPGRSLRLSCAASGFTFDDYAMHWVRQAPGKGLEWVS
GISWNSGSIGYADSVKGRFTISRDNAKNSLYLQMNSLRAEDTAMYYCARYR
QVGSAYDSWGQGTLVTVSS** [SEQ ID NO: 80]

TSGQAGQHHHHHGAYPYDVPDYAS [SEQ ID NO: 308]

TABLE 21

ET200-023

DNA Sequence
(light chain variable region scFv linker heavy chain variable region His tag + HA tag)
ctgcctgtgctgactcagccaccctcggtgtcagtggccccaggaaagacggccaggattacctgtgggggaaacaacattgg
aagtaaaagtgtgcactggtatcagcagaagccaggccaggcccctgtgctggtcgtctatgctgatagcgaccggccctcag
ggatccctgagcggattctctggctccaactctgggaacacggccaccctgaccatcagcagggtcgaagccggggatgaggc
cgactattactgtcaggtgtgggatagtagtagttatcataattatgtcttcggaactgggaccaaggtcaccgtcctaggt [SEQ
ID NO: 81]

<u>tctagaggtggtggtggtagcggcggcggcggctctggtggtggtggatccctcgagatggcc</u> [SEQ ID NO: 305]

**gaggtgcagctggtgcagtctggagctgaggtgaagaagcctggggcctcagtgaaggtctcctgcaaggcttctggtt
acacctttaccagctatggtatcagctgggtgcgacaggcccctggacaagggcttgagtggatgggatggatcagcgc
ttacaatggtaacacaaactatgcacagaagctccagggcagagtcaccatgaccacagacacatccacgagcacagc
ctacatggagctgagcagcctgagatctgaggacaccgccatgtattactgtgcgcgctactggggtttcggtgtttctga
tcgttggggtcaaggtactctggtaccgtctcctca** [SEQ ID NO: 82]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
LPVLTQPPSVSVAPGKTARITCGGNNIGSKSVHWYQQKPGQAPVLVVYADSDRP
SGIPERFSGSNSGNTATLTISRVEAGDEADYYCQVWDSSSYHNYVFGTGTKVTVL
G [SEQ ID NO: 83]

<u>SRGGGGSGGGGSGGGGSLEMA</u> [SEQ ID NO: 307]

**EVQLVQSGAEVKKPGASVKVSCKASGYTFTSYGISWVRQAPGQGLEWMGW
ISAYNGNTNYAQKLQGRVTMTTDTSTSTAYMELSSLRSEDTAMYYCARYW
GFGVSDRWGQGTLVTVSS** [SEQ ID NO: 84]

TSGQAGQHHHHHGAYPYDVPDYAS [SEQ ID NO: 308]

TABLE 22

ET200-024

DNA Sequence
(light chain variable region scFv linker heavy chain variable region His tag + HA tag)
aattttatgctgactcagccccactctgtgtcggagtctccggggaagacggtaaccatctcctgcaccggcagcagtggcagc
attgccagcaactatgtgcagtggtaccagcagcgcccgggcagtgcccccaccactgtgatctatgaggataaccaaagacc
ctctgggtccccgatcggttctctggctccatcgacagctcctccaactctgcctcctccaccatctctgggactgaagactgagg
acgaggctgactactactgtcagtcttatgacagcagcaatctttgggtgttcggcggagggaccaagctgaccgtcctaggt
[SEQ ID NO: 85]

<u>tctagaggtggtggtggtagcggcggcggcggctctggtggtggtggatccctcgagatggcc</u> [SEQ ID NO: 305]

**cagatgcagctggtgcagtctggggctgaggtgaagaagcctgggtcctcggtgaaggtctcctgcaaggcttctggag
gcaccttcagcagctatgctatcagctgggtgcgacaggcccctggacaagggcttgagtggatgggagggatcatccc
tatctttggtacagcaaactacgcacagaagttccagggcagagtcacgattaccgcggacgaatccacgagcacagc
ctacatggagctgagcagcctgagatctgaggacactgccgtgtattactgtgcgcgctacaactactactactacgattc
ttgggggtcaaggtactctggtgaccgtctcctca** [SEQ ID NO: 86]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTGSSGSIASNYVQWYQQRPGSAPTTVIYEDNQR
PSGVPDRFSGSIDSSSNSASLTISGLKTEDEADYYCQSYDSSNLWVFGGGTKLTVL
G [SEQ ID NO: 87]

<u>SRGGGGSGGGGSGGGGSLEMA</u> [SEQ ID NO: 307]

**QMQLVQSGAEVKKPGSSVKVSCKASGGTFSSYAISWVRQAPGQGLEWMGG
IIPIFGTANYAQKFQGRVTITADESTSTAYMELSSLRSEDTAVYYCARYNYYY
YDSWGQGTLVTVSS** [SEQ ID NO: 88]

TSGQAGQHHHHHHGAYPYDVPDYAS [SEQ ID NO: 308]

TABLE 23

ET200-025

DNA Sequence
(light chain variable region scFv linker heavy chain variable region His tag + HA tag)
gacatccagatgacccagtctccatcctccctgtctgcatctgtaggagacagagtcaccatcacttgccgggcaagtcagagca
ttagcagctatttaaattggtatcagcagaaaccagggaaagcccctaagctcctgatctatgctgcatccagtttgcaaagtggg
gtcccatcaaggttcagtggcagtggatctgggacagatttcactctcaccatcagcagtctgcaacctgaagattttgcaacttac
tactgtcaacagagttacagtaccccattcactttcggccctgggaccaaagtggatatcaaacgt [SEQ ID NO: 89]

<u>tctagaggtggtggtggtagcggcggcggcggctctggtggtggtggatccctcgagatggcc</u> [SEQ ID NO: 305]

**gaggtgcagctggtgcagtctggggctgaggtgaagaagcctgggtcctcggtgaaggtctcctgcaaggcttctggag
gcaccttcagcagctatgctatcagctgggtgcgacaggcccctggacaagggcttgagtggatgggagggatcatccc
tatctttggtacagcaaactacgcacagaagttccagggcagagtcacgattaccgcggacgaatccacgagcacagc
ctacatggagctgagcagcctgagatctgaggacaccgccatgtattactgtgcgcgctactggggttacgactcttacg
atgaatggggtcaaggtactctggtgaccgtctcctca** [SEQ ID NO: 90]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
DIQMTQSPSSLSASVGDRVTITCRASQSISSYLNWYQQKPGKAPKLLIYAASSLQS
GVPSRFSGSGSGTDFTLTISSLQPEDFATYYCQQSYSTPFTFGPGTKVDIKR [SEQ
ID NO: 91]

<u>SRGGGGSGGGGSGGGGSLEMA</u> [SEQ ID NO: 307]

**EVQLVQSGAEVKKPGSSVKVSCKASGGTFSSYAISWVRQAPGQGLEWMGGI
IPIFGTANYAQKFQGRVTITADESTSTAYMELSSLRSEDTAMYYCARYWGYD
SYDEWGQGTLVTVSS** [SEQ ID NO: 92]

TSGQAGQHHHHHHGAYPYDVPDYAS [SEQ ID NO: 308]

TABLE 24

ET200-026

DNA Sequence
(light chain variable region scFv linker heavy chain variable region His tag + HA tag)
aattttatgctgactcagccccactctgtgtcggagtctccggggaagacggtaaccatctcctgcaccggcagcagtggcagc
attgccagcaactatgtgcagtggtaccagcagcgcccgggcagtgcccccaccactgtgatctatgaggataaccaaagacc
ctctggggtccctgatcggttctctggctccatcgacagctcctccaactctgcctcctccaccatctctggactgaagactgagg
acgaggctgactactactgtcagtcttatgatagcagcaattgggtgttcggcggagggaccaagctgaccgtcctaggt
[SEQ ID NO: 93]

<u>tctagaggtggtggtggtagcggcggcggcggctctggtggtggtggatccctcgagatggcc</u> [SEQ ID NO: 305]

**gaggtccagctggtgcagtctggggctgaggtgaagaagcctggggtcctcggtgaaggtctcctgcaaggcttctggag
gcaccttcagcagctatgctatcagctgggtgcgacaggcccctggacaagggcttgagtggatgggagggatcatccc
tatctttggtacagcaaactacgcacagaagttccagggcagagtcacgattaccgcggacgaatccacgagcacagc
ctacatggagctgagcagcctgagatctgaggacacggccgtgtattactgtgcgcgcaacaaccattactacaacgatt
actggggtcaaggtactctggtgaccgtctcctca** [SEQ ID NO: 94]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTGSSGSIASNYVQWYQQRPGSAPTTVIYEDNQR
PSGVPDRFSGSIDSSSNSASLTISGLKTEDEADYYCQSYDSSNWVFGGGTKLTVL
G [SEQ ID NO: 95]

<u>SRGGGGSGGGGSGGGGSLEMA</u> [SEQ ID NO: 307]

**EVQLVQSGAEVKKPGSSVKVSCKASGGTFSSYAISWVRQAPGQGLEWMGGI
IPIFGTANYAQKFQGRVTITADESTSTAYMELSSLRSEDTAVYYCARNNHYY
NDYWGQGTLVTVSS** [SEQ ID NO: 96]

TSGQAGQHHHHHHGAYPYDVPDYAS [SEQ ID NO: 308]

TABLE 25

ET200-027

DNA Sequence
(light chain variable region scFv linker heavy chain variable region His tag + HA tag)
cagtctgtgttgacgcagccgccctcagtgtctggggccccagggcaggggtcaccatccctgcactgggagcagctcca
acatcggggcaggttatgatgtacactggtaccagcagcttccaggacagcccccaaactcctcatctatggtaacaacaatcg
gccctcaggggtccctgaccgcttctctggctccaggtctggctcctcagcctcctggccatcactgggctccaggctgaggat
gaggctgattattactgccagtcctatgacagcagcctgagtgatgtggtattcggcggagggaccaaggtcaccgtcctaggt
[SEQ ID NO: 97]

<u>tctagaggtggtggtggtagcggcggcggcggctctggtggtggtggatccctcgagatggcc</u> [SEQ ID NO: 305]

**gaggtccagctggtgcagtctggggctgaggtgaagaagcctggggctacagtgaaaatctcctgcaaggtttctggat
acaccttcaccgactactacatgcactgggtgcaacaggcccctggaaaagggcttgagtggatgggacttgttgatcct
gaagatggtgaaacaatatacgcagagaagttccagggcagagtcaccataaccgcggacacgtctacagacacagc
ctacatggagctgagcagcctgagatctgaggacacggccgtgtattactgtgcgcgctactggtcttactctttcgacta
cctgtacatgccggaaggtaacgattggtggggtcaaggtactctggtgaccgtctcctca** [SEQ ID NO: 98]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSVSGAPGQGVTIPCTGSSSNIGAGYDVHWYQQLPGTAPKLLIYGNNN
RPSGVPDRFSGSRSGSSASLAITGLQAEDEADYYCQSYDSSLSDVVFGGGTKVTV
LG [SEQ ID NO: 99]

<u>SRGGGGSGGGGSGGGGSLEMA</u> [SEQ ID NO: 307]

**EVQLVQSGAEVKKPGATVKISCKVSGYTFTDYYMHWVQQAPGKGLEWMG
LVDPEDGETIYAEKFQGRVTITADTSTDTAYMELSSLRSEDTAVYYCARYWS
YSFDYLYMPEGNDWWGQGTLVTVSS** [SEQ ID NO: 100]

TSGQAGQHHHHHHGAYPYDVPDYAS [SEQ ID NO: 308]

TABLE 26

| ET200-028 |
| --- |

DNA Sequence
(light chain variable region scFv linker heavy chain variable region His tag + HA tag)
cagtctgtgttgactcagccaccccgcagcgtctgggaccccggacagagagtcaccatctcttgttctgggggcgtctccaac
atcgggagtggtgctctaaattggtaccagcaactcccaggaacggcccccaaactcctcatctatagttacaatcagcggccct
caggggtctctgaccgattctctggctccaggtctgccacctcagcctcctggccatcagtgggctccagtctgaggatgaggc
tgattattactgtgcaacctgggatgatagtgtgaatggttgggtgttcggcggagggaccaagctgaccgtcctaggt [SEQ
ID NO: 101]

<u>tctagaggtggtggtggtagcggcggcggcggctctggtggtggtggatccctcgagatggcc</u> [SEQ ID NO: 305]

**caggtccagctggtacagtctggagctgaggtgaagaagcctggggattcagtgaaggtctcctgcaagccttctggtta
caattttctcaactatggtatcaactgggtgcgacaggcccctggacaagggcttgagtggatgggattagcactt
acaccggtaacacaaactatgcacagaagctgcagggcagagtcaccttcaccacagacacatccacgagcacagcct
acatggagatgaggagcctgagatctgacgacacggccgtgtattactgtgcgcgcgacctgtactactacgaaggtgtt
gattactggggtcaaggtactctggtgaccgtctcctca** [SEQ ID NO: 102]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPAASGTPGQRVTISCSGGVSNIGSGALNWYQQLPGTAPKLLIYSYNQR
PSGVSDRFSGSRSATSASLAISGLQSEDEADYYCATWDDSVNGWVFGGGTKLTV
LG [SEQ ID NO: 103]

<u>SRGGGGSGGGGSGGGGSLEMA</u> [SEQ ID NO: 307]

**QVQLVQSGAEVKKPGDSVKVSCKPSGYNFLNYGINWVRQAPGQGLEWMGWIS
TYTGNTNYAQKLQGRVTFTTDTSTSTAYMEMRSLRSDDTAVYYCARDLYYYEG
VDYWGQGTLVTVSS** [SEQ ID NO: 104]

TSGQAGQHHHHHHGAYPYDVPDYAS [SEQ ID NO: 308]

TABLE 27

| ET200-029 |
| --- |

DNA Sequence
(light chain variable region scFv linker heavy chain variable region His tag + HA tag)
caggctgtgctgactcagccaccctcagtgtcagtggccccaggaaagacggccaggggttacctgtgggggaaacaacattg
gaagtgaaagtgtgcactggtaccagcagaagccaggccaggcccctgtgttggtcatctattatgataccgaccggccctcag
ggatccctgagcgattctctggctccactctgggaccacggccaccctgaccatcagcagggtcgaagccggggatgaggc
cgactattactgtcaggtgtgggatagtagtagggatcatgtggtattcggcggagggaccaagctgaccgtcctaggt [SEQ
ID NO: 105]

<u>tctagaggtggtggtggtagcggcggcggcggctctggtggtggtggatccctcgagatggcc</u> [SEQ ID NO: 305]

**caggtgcagctggtgcagtctgggggaggcgtggtccagcctggggaggtccctgagactctcctgtgcggcctctggatt
caccttcagtagctatgctatgcactgggtccgccaggctccaggcaagggactggagtgggtggcagttatatcatatg
atggaagcaataaatactacgcagactccgtgaagggccgattcaccatctccagagacaattccaagaacacgctgta
tctgcaaatgaacagcctgagagctgaggacacggccgtgtattactgtgcgcgctcttacttcactctggtttctacgat
tactggggtcaaggtactctggtgaccgtctcctca** [SEQ ID NO: 106]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QAVLTQPPSVSVAPGKTARVTCGGNNIGSESVHWYQQKPGQAPVLVIYYDTDRP
SGIPERFSGSHSGTTATLTISRVEAGDEADYYCQVWDSSRDHVVFGGGTKLTVLG
[SEQ ID NO: 107]

<u>SRGGGGSGGGGSGGGGSLEMA</u> [SEQ ID NO: 307]

**QVQLVQSGGGVVQPGRSLRLSCAASGFTFSSYAMHWVRQAPGKGLEWVAV
ISYDGSNKYYADSVKGLFTISRDNSKNTLYLQMNSLRAEDTAVYYCARSYFT
SGFYDYWGQGTLVTVSS** [SEQ ID NO: 108]

TSGQAGQHHHHHHGAYPYDVPDYAS [SEQ ID NO: 308]

TABLE 28

ET200-030

DNA Sequence
(light chain variable region scFv linker heavy chain variable region His tag + HA tag)
cagtctgtcgtgacgcagccgcccctcagtgtctggggccccaggcagagggtcaccatctcctgcactgggagcagttccaa
catcggggcaggttatgatgtaaattggtatcagcagtttccaggaacagcccccaaactcctcatctatggtaacagcaatcggc
cctcaggggtccctgaccgattctctggctccaagtctggcacctcagcctcccggccatcactgggctccaggctgaggatg
aggctgattattactgccagtcctatgacagcagcctgagtggctcttatgtcttcggaactgggaccaaggtcaccgtcctaggt
[SEQ ID NO: 109]

tctagaggtggtggtggtagcggcggcggcggctctggtggtggtggatccctcgagatggcc [SEQ ID NO: 305]

cagatgcagctggtgcagtctggggctgaggtgaagaagcctggggcctcagtgaaggtctcctgcaaggcttccggat
acacccTCactgaattatccatgcactgggtgcgacaggctcctggaaaagggcttgagtggatgggaggttttgatcct
gaagatggtgaaacaatctacgcacagaagttccagggcagagtcaccatgaccgaggacacatctacagacacagc
ctacatggagctgagcagcctgagatctgaggacactgccgtgtattactgtgcgcgcatgtcttctatgtactacgattg
gggtcaaggtactctggtgaccgtctcctca [SEQ ID NO: 110]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVVTQPPSVSGAPGQRVTISCTGSSSNIGAGYDVNWYQQFPGTAPKLLIYGNSN
RPSGVPDRFSGSKSGTSASLAITGLQAEDEADYYCQSYDSSLSGSYVFGTGTKVT
VLG [SEQ ID NO: 111]

SRGGGGSGGGGSGGGGSLEMA [SEQ ID NO: 307]

QMQLVQSGAEVKKPGASVKVSCKASGYTLTELSMHWVRQAPGKGLEWMG
GFDPEDGETIYAQKFQGRVTMTEDTSTDTAYMELSSLRSEDTAVYYCARMS
SMYYDWGQGTLVTVSS [SEQ ID NO: 112]

TSGQAGQHHHHHHGAYPYDVPDYAS [SEQ ID NO: 308]

TABLE 29

ET200-031

DNA Sequence
(light chain variable region scFv linker heavy chain variable region His tag + HA tag)
tcctatgtgctgactcagccaccctcagtgtcagtggccccaggaaagacggccaggattacctgtgggggaaacaacattgga
agtaaaagtgtgcactggtaccagcagaagccaggccaggcccctgtgctggtcatctattatgatagcgaccggccctcagg
gatccctgagcgattctctggctccaactctgggaacacggccaccctgaccatcagcagggtcgaagccggggatgaggcc
gactattactgtcaggtgtgggatagtagtagtgattatgtcttcggaactgggaccaaggtcaccgtcctaggt [SEQ ID NO: 113]

tctagaggtggtggtggtagcggcggcggcggctctggtggtggtggatccctcgagatggcc [SEQ ID NO: 305]

gaggtgcagctggtggagactgggggaggcttggtcaagcctggagggtccctgagactctcctgtgcagcctctggatt
caccgtcagtgactactacatgagctggatccgccaggctccagggaagggcctggagtggatttcatacattagtggta
gtggtaatagcatatactacgcagactctgtgaagggccgattcaccatctccagggacaacgccaagaactcactgga
tctgcaaatgaccagcctgagagccgaggacacggccgtatattactgtgcgcgctctactaaattcgattactggggtc
aaggtactctggtgaccgtctcctca [SEQ ID NO: 114]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
SYVLTQPPSVSVAPGKTARITCGGNNIGSKSVHWYQQKPGQAPVLVIYYDSDRPS
GIPERFSGSNSGNTATLTISRVEAGDEADYYCQVWDSSSDYVFGTGTKVTVLG
[SEQ ID NO: 115]

SRGGGGSGGGGSGGGGSLEMA [SEQ ID NO: 307]

EVQLVETGGGLVKPGGSLRLSCAASGFTVSDYYMSWIRQAPGKGLEWISYIS
GSGNSIYYADSVKGRFTISRDNAKNSLDLQMTSLRAEDTAVYYCARSTKFDY
WGQGTLVTVSS [SEQ ID NO: 116]

TSGQAGQHHHHHHGAYPYDVPDYAS [SEQ ID NO: 308]

TABLE 30

ET200-032

DNA Sequence
(light chain variable region scFv linker heavy chain variable region His tag + HA tag)
ctgcctgtgctgactcagccaccctcagcgtctggaccccgggcagagggtcaccatctcttgttctggaagcagctccaac
gtcggaagttacactgtaaactggtaccggcaactcccaggaacggcccccacactcctcatctataataataatcagcggccct
caggggtccctgaccgattctctgactccaagtctggcacctcggcctcctgaccattagtgggctccagcctgaggatgagg
ctgattattattgtgcagcatgggatgacaggctgggtggttatgtcttcggaactgggaccaaggtcaccgtcctaggt [SEQ
ID NO: 117]

<u>tctagaggtggtggtggtagcggcggcggcggctctggtggtggtggatccctcgagatggcc</u> [SEQ ID NO: 305]

**gaggtgcagctggtgcagtctggagcagaggtgaaaaagccggggggagtctctgaagatctcctgtaagggttctggat
acagctttaccaactactggatcggctgggtgcgccagatgcccgggaaaggcctgagtggatggggatcatctatcc
tggtgactctgataccagatacagcccgtcctccaaggcaggtcaccatctcagccgacaagtccatcagcaccgcct
acctacagtggagcagcctgaaggcctcggacaccgccatgtattactgtgcgcgctctactggttcttctcatatgtctga
tgaatggggtcaaggtactctggtgaccgtctcctca** [SEQ ID NO: 118]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
LPVLTQPPSASGTPGQRVTISCSGSSSNVGSYTVNWYRQLPGTAPTLLIYNNNQRP
SGVPDRFSDSKSGTSASLTISGLQPEDEADYYCAAWDDRLGGYVFGTGTKVTVL
G [SEQ ID NO: 119]

<u>SRGGGGSGGGGSGGGGSLEMA</u> [SEQ ID NO: 307]

**EVQLVQSGAEVKKPGESLKISCKGSGYSFTNYWIGWVRQMPGKGLEWMGI
IYPGDSDTRYSPSFQGQVTISADKSISTAYLQWSSLKASDTAMYYCARSTGSS
HMSDEWGQGTLVTVSS** [SEQ ID NO: 120]

TSGQAGQHHHHHHGAYPYDVPDYAS [SEQ ID NO: 308]

TABLE 31

ET200-033

DNA Sequence
(light chain variable region scFv linker heavy chain variable region His tag + HA tag)
aattttatgctgactcagccccactctgtgtcggagtctccggggaagacggtaaccatctcctgcaccggcagcagtggcagc
attgccagcaactatgtgcagtggtaccagcagcgcccgggcagtgcccccaccactgtgatctatgaggataaccaaagacc
ctctggggtccctgatcggttctctggctccatcgacagctcctccaactctgcctccctcaccatctctggactgaagactgagg
acgaggctgactactgtcagtcttatgatagcagcaatcattgggtgttcggcggagggaccaagctgaccgtcctaggt
[SEQ ID NO: 121]

<u>tctagaggtggtggtggtagcggcggcggcggctctggtggtggtggatccctcgagatggcc</u> [SEQ ID NO: 305]

**caagtgcagctacagcagtggggcgcaggactgttgaagccttcggagaccctgtccctcacctgcgctgtctatggtgg
gtccttcagtggttactactggagctggatccgccagcccccagggaaggggctggagtggattggggagatcactcat
agtggaaggtccaactacaacccgtccctcaagagtcgagtcaccatatcagtagacacgtccaagaaccagttctccc
tgaagctgagctctgtgaccgccgcggacacggccgtgtattactgtgcgcgctcttctatcatgtctgattactggggtca
aggtactctggtgaccgtctcctca** [SEQ ID NO: 122]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTGSSGSIASNYVQWYQQRPGSAPTTVIYEDNQR
PSGVPDRFSGSIDSSSNSASLTISGLKTEDEADYYCQSYDSSNHWVFGGGTKLTV
LG [SEQ ID NO: 123]

<u>SRGGGGSGGGGSGGGGSLEMA</u> [SEQ ID NO: 307]

**QVQLQQWGAGLLKPSETLSLTCAVYGGSFSGYYWSWIRQPPGKGLEWIGEI
THSGRSNYNPSLKSRVTISVDTSKNQFSLKLSSVTAADTAVYYCARSSIMSDY
WGQGTLVTVSS** [SEQ ID NO: 124]

TSGQAGQHHHHHHGAYPYDVPDYAS [SEQ ID NO: 308]

TABLE 32

ET200-034

DNA Sequence
(light chain variable region scFv linker heavy chain variable region His tag + HA tag)
cagtctgtgttgacgcagccgccctcagtgtctggggccccagggcagagggtcaccatctcctgcactgggagcacctccaa
catcggggcaggttatgatgtacactggtaccagcagcttcaggaacagccccaaactcctcatcaacaataacaggaatcg
gccctcaggggtccctgaccgattctctggctccaagtctggcacgtcagccaccctgggcatcaccggactccagactgggg
acgaggccgattattactgcgaacatgggatggcagcctgactggtgcagtgttcggcggagggaccaagctgaccgtcccta
ggt [SEQ ID NO: 125]

<u>tctagaggtggtggtggtagcggcggcggcggctctggtggtggtggatccctcgagatggcc</u> [SEQ ID NO: 305]

**gaggtccagctggtgcagtctggggctgaggtgaagaagcctgggtcctcggtgaaggtctcatgcaaggcttctggag
gcaccttcagcagctatgctatcagctgggtgcgacaggcccctggacaagggcttgagtggatgggagggatcatccc
tatctttggtacagcaaactacgcacagaagttccagggcagagtcacgattaccgcggacgaatccacgagcacagc
ctacatggagctgagcagcctgagatctgaggacacggccgtgtattactgtgcgcgcggttctgctctggaccattacg
atcgttggggtcaaggtactctggtgaccgtctcctca** [SEQ ID NO: 126]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSVSGAPGQRVTISCTGSTSNIGAGYDVHWYQQLPGTAPKLLINNNRN
RPSGVPDRFSGSKSGTSATLGITGLQTGDEADYYCGTWDGSLTGAVFGGGTKLT
VLG [SEQ ID NO: 127]

<u>SRGGGGSGGGGSGGGGSLEMA</u> [SEQ ID NO: 307]

**EVQLVQSGAEVKKPGSSVKVSCKASGGTFSSYAISWVRQAPGQGLEWMGGI
IPIFGTANYAQKFQGRVTITADESTSTAYMELSSLRSEDTAVYYCARGSALDH
YDRWGQGTLVTVSS** [SEQ ID NO: 128]

TSGQAGQHHHHHHGAYPYDVPDYAS [SEQ ID NO: 308]

TABLE 33

ET200-035

DNA Sequence
(light chain variable region scFv linker heavy chain variable region His tag + HA tag)
aatttatgctgactcagccccactctgtgtcggagtctccggggaagacggtaaccatctcctgcacccgcagcagtggcagca
ttgccagcaactatgtgcagtggtaccagcagcgcccgggcagtgccccaccactgtgatctatgaggataaccaaagaccct
ctggggtccctgatcggttctctggctccatcgacagctcctccaactctgcctccctcaccatctctggactgaagactgaggac
gaggctgactactactgtcagtcttatgatagcaccaattgggtgttcggcggagggaccaagctgaccgtcctaggt [SEQ
ID NO: 129]

<u>tctagaggtggtggtggtagcggcggcggcggctctggtggtggtggatccctcgagatggcc</u> [SEQ ID NO: 305]

**caggtgcagctggtgcagtctggggctgaggtgaagaagcctgggtcctcggtgaaggtctcctgcaaggcttctggag
gcaccttcagcagctatgctatcagctgggtgcgacaggcccctggacaagggcttgagtggatgggagggatcatccc
tatctttggtacagcaaactacgcacagaagttccagggcagagtcacgattaccgcggacgaatccacgagcacagc
ctacatggagctgagcagcctgagatctgaggacactgccgtgtattactgtgcgcgctacaactacttcaacgatta
ctggggtcaaggtactctggtgaccgtctcctca** [SEQ ID NO: 130]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSTNWVFGGGTKLTVLG
[SEQ ID NO: 131]

<u>SRGGGGSGGGGSGGGGSLEMA</u> [SEQ ID NO: 307]

**QVQLVQSGAEVKKPGSSVKVSCKASGGTFSSYAISWVRQAPGQGLEWMGGI
IPIFGTANYAQKFQGRVTITADESTSTAYMELSSLRSEDTAVYYCARYNYFN
DYWGQGTLVTVSS** [SEQ ID NO: 132]

TSGQAGQHHHHHHGAYPYDVPDYAS [SEQ ID NO: 308]

TABLE 34

ET200-037

DNA Sequence
(light chain variable region scFv linker heavy chain variable region His tag + HA tag)
tcctatgtgctgactcagccaccctcagtgtcagtggccccaggaaagacggccaggattacctgtgggggaaacaacattgga
agtaaaagtgtgcactggtaccagcagaagccaggccaggcccctgtgctggtcatctattatgatagcgaccggccctcagg
gatccctgagcgattctctggctccaactctgggaacacggccaccctgaccatcagcagggtcgaagccggggatgaggcc
gactattactgtcaggtgtgggatagtagtagtgatcatccttatgtcttcggaactgggaccaaggtcaccgtcctaggt [SEQ
ID NO: 133]

<u>tctagaggtggtggtggtagcggcggcggcggctctggtggtggtggatccctcgagatggcc</u> [SEQ ID NO: 305]

**cagatgcagctggtgcagtctggagctgaggtgaagaagcctggggcctcagtgaaggtctcctgcaaggcttctggtt
acacctttaccagctatggtatcagctgggtgcgacaggcccctggacaagggcttgagtggatgggatggatcagcgc
ttacaatggtaacacaaactatgcacagaagctccagggcagagtcaccatgaccacagacacatccacgagcacagc
ctacatggagctgaggagcctgagatctgacgacactgccgtgtattactgtgcgcgctctatgttcggtgctcatgattct
tggggtcaaggtactctggtgaccgtctcctca** [SEQ ID NO: 134]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
SYVLTQPPSVSVAPGKTARITCGGNNIGSKSVHWYQQKPGQAPVLVIYYDSDRPS
GIPERFSGSNSGNTATLTISRVEAGDEADYYCQVWDSSSDHPYVFGTGTKVTVLG
[SEQ ID NO: 135]

<u>SRGGGGSGGGGSGGGGSLEMA</u> [SEQ ID NO: 307]

**QMQLVQSGAEVKKPGASVKVSCKASGYTFTSYGISWVRQAPGQGLEWMG
WISAYNGNTNYAQKLQGRVTMTTDTSTSTAYMELRSLRSDDTAVYYCARS
MFGAHDSWGQGTLVTVSS** [SEQ ID NO: 136]

TSGQAGQHHHHHHGAYPYDVPDYAS [SEQ ID NO: 308]

TABLE 35

ET200-038

DNA Sequence
(light chain variable region scFv linker heavy chain variable region His tag + HA tag)
cagtctgtgttgacgcagccgccctcagtgtctggggcccagggcagagggtcaccatctcctgcactgggagcagctccaa
catcggggcaggttttgatgtacactggtaccagctacttccaggaacagccccaaactcctcatctatgctaacagcaatcgg
ccctcaggggtccctgaccgattctctggctccaagtctggcacctcagcctccctggccatcactgggctcctggctgaggatg
aggctgattattactgccagtcctatgacagcagcctgagtggtgtggtattcggcggagggaccaagctgaccgtcctaggt
[SEQ ID NO: 137]

<u>tctagaggtggtggtggtagcggcggcggcggctctggtggtggtggatccctcgagatggcc</u> [SEQ ID NO: 305]

**caggtgcagctggtgcaatctggggctgaggtgaagaagcctgggtcctcggtgaaggtctcctgcaaggcttctggag
gcaccttcagcagctatgctatcagctgggtgcgacaggcccctggacaagggcttgagtggatgggagggatcatccc
tatctttggtacagcaaactacgcacagaagttccagggcagagtcacgattaccgcggacgaatccacgagcacagc
ctacatggagctgagcagcctgagatctgaggacactgccgtgtattactgtgcgcgcggtgcttctttcgaccgtcatga
taactggggtcaaggtactctggtgaccgtctcctca** [SEQ ID NO: 138]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSVSGAPGQRVTISCTGSSSNIGAGFDVHWYQLLPGTAPKLLIYANSN
RPSGVPDRFSGSKSGTSASLAITGLLAEDEADYYCQSYDSSLSGVVFGGGTKLTV
LG [SEQ ID NO: 139]

<u>SRGGGGSGGGGSGGGGSLEMA</u> [SEQ ID NO: 307]

**QVQLVQSGAEVKKPGSSVKVSCKASGGTFSSYAISWVRQAPGQGLEWMGGI
IPIFGTANYAQKFQGRVTITADESTSTAYMELSSLRSEDTAVYYCARGASFDR
HDNWGQGTLVTVSS** [SEQ ID NO: 140]

TSGQAGQHHHHHHGAYPYDVPDYAS [SEQ ID NO: 308]

TABLE 36

ET200-039

DNA Sequence
(light chain variable region scFv linker heavy chain variable region His tag + HA tag)
aattttatgctgactcagccccactctgtgtcggagtctccggggaagacggtaaccatctcctgcacccgcagcagtggcagca
ttgccagcaactatgtgcagtggtaccagcagcgcccggcagttccccaccactgtgatctatgaggataaccaaagaccct
ctggggtccctgatcggttctctggctccatcgacagctcctccaactctgcctccctcaccatctctggactgaagactgaggac
gaggctgactactactgtcagtcttatgatagcagcaattgggtgttcggcggagggaccaagctgaccgtcctaggt [SEQ ID NO: 141]

<u>tctagaggtggtggtggtagcggcggcggcggctctggtggtggtggatccctcgagatggcc</u> [SEQ ID NO: 305]

**gaggtccagctggtgcagtctggggctgaggtgaagaagcctggggtcctcggtgaaggtctcctgcaaggcttctggag
gcaccttcagcagctatgctatcagctgggtgcgacaggcccctggacaagggcttgagtggatgggagggatcatccc
tatctttggtacagcaaactacgcacagaagttccagggcagagtcacgattaccgcggacgaatccacgagcacagc
ctacatggagctgagcagcctgagatctgaggacacggccgtgtattactgtgcgcgctctaactactactacaacgatt
actggggtcaaggtactctggtgaccgtctcctca** [SEQ ID NO: 142]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTRSSGSIASNYVQWYQQRPGSSPTTVIYEDNQRP
SGVPDRFSGSIDSSSNSASLTISGLKTEDEADYYCQSYDSSNWVFGGGTKLTVLG
[SEQ ID NO: 143]

<u>SRGGGGSGGGGSGGGGSLEMA</u> [SEQ ID NO: 307]

**EVQLVQSGAEVKKPGSSVKVSCKASGGTFSSYAISWVRQAPGQGLEWMGGI
IPIFGTANYAQKFQGRVTITADESTSTAYMELSSLRSEDTAVYYCARSNYYYN
DYWGQGTLVTVSS** [SEQ ID NO: 144]

TSGQAGQHHHHHGAYPYDVPDYAS [SEQ ID NO: 308]

TABLE 37

ET200-040

DNA Sequence
(light chain variable region scFv linker heavy chain variable region His tag + HA tag)
cagtctgtgttgacgcagccgccctcagtgtctggggccccagggcagagggtcaccatctcctgcactgggagcagctccaa
catcggggcaggttatgatgtacactggtaccagcagcttccaggaacagcccccaaactcctcatctatggtaacagcaatcg
gccctcaggggtccctgaccgattctctggctccaagtctggcacctcagcctccctggccatcactgggctccaggctgagga
tgaggctgattattactgccagtcctatgacagcagcctgagtggttatgtcttcggaactgggaccaaggtcaccgtcctaggt
[SEQ ID NO: 145]

<u>tctagaggtggtggtggtagcggcggcggcggctctggtggtggtggatccctcgagatggcc</u> [SEQ ID NO: 305]

**caggtgcagctggtgcagtctggggctgaggtgaagaagcctggggcctcagtgaaggtctcctgcaaggtttccggat
acaccctcactgaattatccatgcactgggtgcgacaggctcctggaaaagggcttgagtggatgggaggttttgatcct
gaagatggtgaaacaatctacgcacagaagttccagggcagagtcaccatgaccgaggacacatctacagacacagc
ctacatggagctgagcagcctgagatctgaggacactgccgtgtattactgtgcgcgctactctggtgtttactacgattg
gggtcaaggtactctggtgaccgtctcctca** [SEQ ID NO: 146]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSVSGAPGQRVTISCTGSSSNIGAGYDVHWYQQLPGTAPKLLIYGNSN
RPSGVPDRFSGSKSGTSASLAITGLQAEDEADYYCQSYDSSLSGYVFGTGTKVTV
LG [SEQ ID NO: 147]

<u>SRGGGGSGGGGSGGGGSLEMA</u> [SEQ ID NO: 307]

**QVQLVQSGAEVKKPGASVKVSCKVSGYTLTELSMHWVRQAPGKGLEWMG
GFDPEDGETIYAQKFQGRVTMTEDTSTDTAYMELSSLRSEDTAVYYCARYS
GVYYDWGQGTLVTVSS** [SEQ ID NO: 148]

TSGQAGQHHHHHGAYPYDVPDYAS [SEQ ID NO: 308]

TABLE 38

ET200-041

DNA Sequence
(light chain variable region scFv linker heavy chain variable region His tag + HA tag)
aattttatgctgactcagcccactctgtgtcggggtctccggggaagacggtaaccatctcctgcaccggcagcagtggcagc
attgccgacaactttgtgcagtggtaccagcagcgcccgggcggtgtccccaccactgtgatctttaatgatgacgaaagaccct
ctggcgtccctgatcggttctctggctccatcgacacctcctccaattctgcctccctcaccatctctggactgaagactgaggacg
aggctgactactactgtcagtcttatgataataataatcgaggggtgttcggcggagggaccaagctgaccgtcctaggt
[SEQ ID NO: 149]

<u>tctagaggtggtggtggtagcggcggcggcggctctggtggtggtggatccctcgagatggcc</u> [SEQ ID NO: 305]

**caggtccagctggtgcagtctggggctgaggtgaagaagcctgggtcctcggtgaaggtctcctgcaaggcttctggag
gcaccttcagcagctatgctatcagctgggtgcgacaggcccctggacaagggcttgagtggatgggatggatgaaccc
taacagtggtaacacaggctatgcacagaagttccagggcagagtcaccatgaccaggaacacctccataagcacagc
ctacatggagctgagcaacctgagatctgaggacacggccgtgtattactgtgcgcgctactactcttacggttacgattg
gggtcaaggtactctggtaccgtctcctca** [SEQ ID NO: 150]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
NFMLTQPHSVSGSPGKTVTISCTGSSGSIADNFVQWYQQRPGGVPTTVIFNDDER
PSGVPDRFSGSIDTSSNSASLTISGLKTEDEADYYCQSYDNNNRGVFGGGTKLTV
LG [SEQ ID NO: 151]

<u>SRGGGGSGGGGSGGGGSLEMA</u> [SEQ ID NO: 307]

**QVQLVQSGAEVKKPGSSVKVSCKASGGTFSSYAISWVRQAPGQGLEWMGW
MNPNSGNTGYAQKFQGRVTMTRNTSISTAYMELSNLRSEDTAVYYCARYYS
YGYDWGQGTLVTVSS** [SEQ ID NO: 152]

TSGQAGQHHHHHHGAYPYDVPDYAS [SEQ ID NO: 308]

TABLE 39

ET200-042

DNA Sequence
(light chain variable region scFv linker heavy chain variable region His tag + HA tag)
cagtctgtcgtgacgcagccgccctcagtgtctggggccccagggcagacggtcaccatctcctgcactgggggcagctccaa
catcgggacaggttatttttgtaaattggtaccagcaggttccaggaaaagcccccaaactcctcatcctgggtaacaataatcggc
cctcgggggtccctgaccgactctcggctccacgtccggcacctcagcctcctggccatcactgggctccaggctgaggat
gagggtacttattactgccagtcctatgacagcagcctgagtggttatgtcttcggaactgggaccaaggtcaccgtcctaggt
[SEQ ID NO: 153]

<u>tctagaggtggtggtggtagcggcggcggcggctctggtggtggtggatccctcgagatggcc</u> [SEQ ID NO: 305]

**caggtacagctgcagcagtcaggtccaggactggtgaagccctcgcagaccctctcactcacctgtggcatctccggggg
acagtgtctctaccaacagtgttgcttggcactggatcaggcagtccccatcgagaggccttgagtggctgggaaggac
atactacaggtccaagtggtctaatgactatggagtatctgtgaaaagtcgaatcaccatcatcccagacacatccaaga
accagttctccctgcagctgaactctgtgactcccgaggacacggccgtgtattactgtgcgcgctcttcttcttggtacca
gatcttcgattactggggtcaaggtactctggtaccgtctcctca** [SEQ ID NO: 154]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVVTQPPSVSGAPGQTVTISCTGSSNIGTGYFVNWYQQVPGKAPKLLILGNNN
RPSGVPDRLSGSTSGTSASLAITGLQAEDEGTYYCQSYDSSLSGYVFGTGTKVTV
LG [SEQ ID NO: 155]

<u>SRGGGGSGGGGSGGGGSLEMA</u> [SEQ ID NO: 307]

**QVQLQQSGPGLVKPSQTLSLTCGISGDSVSTNSVAWHWIRQSPSRGLEWLG
RTYYRSKWSNDYGVSVKSRITIIPDTSKNQFSLQLNSVTPEDTAVYYCARSSS
WYQIFDYWGQGTLVTVSS** [SEQ ID NO: 156]

TSGQAGQHHHHHHGAYPYDVPDYAS [SEQ ID NO: 308]

TABLE 40

ET200-043

DNA Sequence
(light chain variable region scFv linker heavy chain variable region His tag + HA tag)
aattttatgctgactcagccccactctgtgtcggagtctccggggaagacggtaaccatctcctgcaccggcagcagcgacagc
atagccaacaactatgttcagtggtaccagcagcgcccgggcagtgcccccaccaatgtgatctacgaagatgtccaaagacc
ctctgggtccctgatcggttctctgggtccatcgacagctcctccaactctgcctcctcaccatctctggactgaagactgagg
acgaggctgtctactattgtcagtcttatcatagcgacaatcgttgggtgttcggcggcgggaccaagctgaccgtcctaggt
[SEQ ID NO: 157]

<u>tctagaggtggtggtggtagcggcggcggcggctctggtggtggtggatccctcgagatggcc</u> [SEQ ID NO: 305]

**caggtgcagctggtggagtctgggggaggcttggtacagcctggggggtccctgagactctcctgtgcagcctctggatt
cacctttagcagctatgccatgagctgggtccgccaggctccagggaaggggctggagtgggtctcagctattagtggta
gtggtggtagcacatactacgcagactccgtgaagggccggttcaccatctccagagacaattccaagaacacgctgta
tctgcaaatgaacagcctgagagccgaggacacggccgtatattactgtgcgcgctctggtgcttactgggactactctgt
ttacgatgaatggggtcaaggtactctggtgaccgtctcctca** [SEQ ID NO: 158]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTGSSDSIANNYVQWYQQRPGSAPTNVIYEDVQR
PSGVPDRFSGSIDSSSNSASLTISGLKTEDEAVYYCQSYHSDNRWVFGGGTKLTV
LG [SEQ ID NO: 159]

<u>SRGGGGSGGGGSGGGGSLEMA</u> [SEQ ID NO: 307]

**QVQLVESGGGLVQPGGSLRLSCAASGFTFSSYAMSWVRQAPGKGLEWVSAI
SGSGGSTYYADSVKGRFTISRDNSKNTLYLQMNSLRAEDTAVYYCARSGAY
WDYSVYDEWGQGTLVTVSS** [SEQ ID NO: 160]

TSGQAGQHHHHHGAYPYDVPDYAS [SEQ ID NO: 308]

TABLE 41

ET200-044

DNA Sequence
(light chain variable region scFv linker heavy chain variable region His tag + HA tag)
cagtctgtgttgactcagccacctcagtgtccgtgtccccaggacagacagccaccatcgcctgttctggacataaattgggg
ataaatatgcttcctggtatcagcagaagtcgggccagtccctgtgttgatcatctatcaggataataagcggccctcagggattc
ctgagcgattctctggctccaactctgggaacacagccactctgaccatcagcgggacccaggctctggatgaggctgactatta
ttgtcaggcgtgggacagtagtacttatgtggcattcggcggagggaccaagctgaccgtcctaggt [SEQ ID NO:
161]

<u>tctagaggtggtggtggtagcggcggcggcggctctggtggtggtggatccctcgagatggcc</u> [SEQ ID NO: 305]

**caggtgcagctgcaggagtccggcccaggactggtgaagccttcggagaccctgtccctcacctgcgttgtctctggtgg
ctccatcagcagtagtaactggtggagctgggtccgccagcccccagggaaggggctggagtggattggggaaatctat
catagtgggagccccaactacaacccatccctcaagagtcgagtcaccatatcagtagacaagtccaagaaccagttct
ccctgaagctgagctctgtgaccgccgcggacacggccgtgtattactgtgcgcgcatgactactcatactttcggttacg
atgcttggggtcaaggtactctggtgaccgtctcctca** [SEQ ID NO: 162]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSVSVSPGQTATIACSGHKLGDKYASWYQQKSGQSPVLIIYQDNKRPS
GIPERFSGSNSGNTATLTISGTQALDEADYYCQAWDSSTYVAFGGGTKLTVLG
[SEQ ID NO: 163]

<u>SRGGGGSGGGGSGGGGSLEMA</u> [SEQ ID NO: 307]

**QVQLQESGPGLVKPSETLSLTCVVSGGSISSSNWWSWVRQPPGKGLEWIGEI
YHSGSPNYNPSLKSRVTISVDKSKNQFSLKLSSVTAADTAVYYCARMTTHTF
GYDAWGQGTLVTVSS** [SEQ ID NO: 164]

TSGQAGQHHHHHGAYPYDVPDYAS [SEQ ID NO: 308]

TABLE 42

ET200-045

DNA Sequence
(light chain variable region scFv linker heavy chain variable region His tag + HA tag)
cagcctgtgctgactcagccaccctcagtgtcagtggccccaggaaagacggccacgattacttgtgggggaaacaacattgg
aagtgaaagtgtgcactggtaccaccagaagccaggccaggcccctgtgttggtcatctatgatgatgccggccggccctcag
ggatccctgagcgattcactggctccaactctgggaacacggccaccctgaccatcagcagggtcgaagccggggatgaggc
cgactattactgtcaggtgtgggacagaaatagtgctcagtttgtcttcggacctgggaccaaggtcaccgtcctaggt [SEQ
ID NO: 165]

<u>tctagaggtggtggtggtagcggcggcggcggctctggtggtggtggatccctcgagatggcc</u> [SEQ ID NO: 305]

**gaggtccagctggtgcagtctggagctgaggtgaagaagcctggggcctcagtgaaggtctcctgcaaggcttctggtt
acacctttaccagctatggtatcagctgggtgcgacaggcccctggacaagggcttgagtggatgggatggatcagcgc
ttacaatggtaacacaaactatgcacagaagctccagggcagagtcaccatgaccacagacacatccacgagcacagc
ctacatggagctgaggagcctgagatctgacgacacggccgtgtattactgtgcgcgcggtgttcatctggattggtggg
gtcaaggtactctggtgaccgtctcctca** [SEQ ID NO: 166]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QPVLTQPPSVSVAPGKTATITCGGNNIGSESVHWYHQKPGQAPVLVIYDDAGRPS
GIPERFTGSNSGNTATLTISRVEAGDEADYYCQVWDRNSAQFVFGPGTKVTVLG
[SEQ ID NO: 167]

<u>SRGGGGSGGGGSGGGGSLEMA</u> [SEQ ID NO: 307]

**EVQLVQSGAEVKKPGASVKVSCKASGYTFTSYGISWVRQAPGQGLEWMGW
ISAYNGNTNYAQKLQGRVTMTTDTSTSTAYMELRSLRSDDTAVYYCARGVH
LDWWGQGTLVTVSS** [SEQ ID NO: 168]

TSGQAGQHHHHHGAYPYDVPDYAS [SEQ ID NO: 308]

TABLE 43

ET200-069

DNA Sequence
(light chain variable region scFv linker heavy chain variable region His tag + HA tag)
cagtctgtcgtgacgcagccaccctcagcgtctgggaccccggggcagagggtcaccatctcttgttctggaagcagctccaac
atcggaagtaattatgtatactggtaccagcagctcccaggaacggccccccaaactcctcatctatagtaataatcagcggccctc
aggggtccctgaccgattctctggctccaagtctggcacctcagcctccctggccatcagtgggctccggtccgaggatgaggc
tgattattactgtgcagcatgggatgacagcctgagtggttatgtcttcggaactgggaccaagctgaccgtcctaggt [SEQ
ID NO: 169]

<u>tctagaggtggtggtggtagcggcggcggcggctctggtggtggtggatccctcgagatggcc</u> [SEQ ID NO: 305]

**caggtgcagctacagcagtggggcgcaggactgttgaagccttcggagaccctgtcctcacctgcgctgtctatggtgg
gtccttcagtggttactactggagctggatccgccagcccccagggaaggggctggagtggattggggaaatcaatcat
agtggaagcaccaactacaacccgtccctcaagagtcgagtcaccatatcagtagacacgtccaagaaccagttctccc
tgaagctgagctctgtgaccgccgcggacacggccgtgtattactgtgcgcgcctgtacgaaggtggttaccatggttgg
ggttcttggctgtcttctgattcttggggtcaaggtactctggtgaccgtctcctca** [SEQ ID NO: 170]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVVTQPPSASGTPGQRVTISCSGSSSNIGSNYVYWYQQLPGTAPKLLIYSNNQRP
SGVPDRFSGSKSGTSASLAISGLRSEDEADYYCAAWDDSLSGYVFGTGTKLTVL
G [SEQ ID NO: 171]

<u>SRGGGGSGGGGSGGGGSLEMA</u> [SEQ ID NO: 307]

**QVQLQQWGAGLLKPSETLSLTCAVYGGSFSGYYWSWIRQPPGKGLEWIGEI
NHSGSTNYNPSLKSRVTISVDTSKNQFSLKLSSVTAADTAVYYCARLYEGGY
HGWGSWLSSDSWGQGTLVTVSS** [SEQ ID NO: 172]

TSGQAGQHHHHHGAYPYDVPDYAS [SEQ ID NO: 308]

TABLE 44

ET200-078

DNA Sequence
(light chain variable region scFv linker heavy chain variable region His tag + HA tag)
cagtctgtgttgactcagccaccctcagcgtctgggaccccgggcagagggtcaccatctcttgttctggaagcagctccaaca
tcggaagtaatactgtaaactggtaccagcagctcccaggaacggcccccaaactcctcatctatagtaataatcagcggccctc
aggggtccctgaccgattctctggctccaagtctggcacctcagcctccctggccatcagtgggctccagtctgaggatgaggct
gattattactgtgcagcatgggatgacagcctgaatggttattgggtgttcggcggagggaccaagctgaccgtcctaggt
[SEQ ID NO: 173]

<u>tctagaggtggtggtggtagcggcggcggcggctctggtggtggtggatccctcgagatggcc</u> [SEQ ID NO: 305]

**caggtgcagctacagcagtggggcgcaggactgttgaagccttcggagaccctgtccctcacctgcgctgtctatggtgg
gtccttcagtggttactactgagctggatccgccagccccagggaaggggctggagtggattggggaaatcaatcat
agtgaagcaccaactacaacccgtccctcaagagtcgagtcaccatatcagtagacacgtccaagaaccagttctccc
tgaagctgagctctgtgaccgccgcggacacggctgtgtattactgtgcgcgcgaaggggcatttgatgcttttgatatct
ggggccaagggacaatggtcaccgtctcttca** [SEQ ID NO: 174]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYWVFGGGTKLTV
LG [SEQ ID NO: 175]

<u>SRGGGGSGGGGSGGGGSLEMA</u> [SEQ ID NO: 307]

**QVQLQQWGAGLLKPSETLSLTCAVYGGSFSGYYWSWIRQPPGKGLEWIGEINHS
GSTNYNPSLKSRVTISVDTSKNQFSLKLSSVTAADTAVYYCAREGAFDAFDIWG
QGTMVTVS** [SEQ ID NO: 176]

TSGQAGQHHHHHGAYPYDVPDYAS [SEQ ID NO: 308]

TABLE 45

ET200-079

DNA Sequence
(light chain variable region scFv linker heavy chain variable region His tag + HA tag)
tcctatgagctgactcagccaccctcagcgtctgggaccccgggcagagggtcaccatctcttgttctggaagcagctccaac
atcggaagtaattatgtatactggtaccagcagctcccaggaacggcccccaaactcttcatctataggaataatcagcggccctc
aggggtccctgaccgattctctggctccaagtctggcacctcagcctccctggccatcagtgggctccggtccgaggatgaggc
tgattattactgtgcagcatgggatgacagcctgagtggttatctcttcggaactgggaccaaggtcaccgtcctaggt [SEQ
ID NO: 177]

<u>tctagaggtggtggtggtagcggcggcggcggctctggtggtggtggatccctcgagatggcc</u> [SEQ ID NO: 305]

**gaggtgcagctggtggagtctgggggaggcttggtacagcctggcaggtccctgagactctcctgtgcagcctctggatt
cacctttgatgattatgccatgcactgggtccggcaagctccagggaagggcctggagtgggtctcaggtattagttgga
atagtggtagcataggctatgcggactctgtgaagggccgattcaccatctccagagacaacgccaagaactccctgtat
ctgcaaatgaacagtctgagagctgaggacacggcctgtattactgtgcaaatggcgactccaactactacggtat
ggacgtctggggccaagggaccacggtcaccgtctcctca** [SEQ ID NO: 178]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
SYELTQPPSASGTPGQRVTISCSGSSSNIGSNYVYWYQQLPGTAPKLFIYRNNQRP
SGVPDRFSGSKSGTSASLAISGLRSEDEADYYCAAWDDSLSGYLFGTGTKVTVL
G [SEQ ID NO: 179]

<u>SRGGGGSGGGGSGGGGSLEMA</u> [SEQ ID NO: 307]

**EVQLVESGGGLVQPGRSLRLSCAASGFTFDDYAMHWVRQAPGKGLEWVSG
ISWNSGSIGYADSVKGRFTISRDNAKNSLYLQMNSLRAEDTALYYCANGDSN
YYYGMDVWGQGTTVTVSS** [SEQ ID NO: 180]

TSGQAGQHHHHHGAYPYDVPDYAS [SEQ ID NO: 308]

TABLE 46

ET200-081

DNA Sequence
(light chain variable region scFv linker heavy chain variable region His tag + HA tag)
cagtctgccctgactcagcctgcctccgtgtccgggtctcctggacagtcgatcaccatctcctgcactggaaccagcagtgaca
ttggtggttataactatgtctcctggtaccaacaacacccaggcaaagcccccaaactcatgatttatgatgtcagtaatcggccct
caggggtttctaatcgcttctctggctccaagtctggcaacacggcctcctgaccatctctgggctccaggctgaggacgaggc
tgattattactgcatctcatatacacgcacctggaaccctatgtcttcgggagtgggaccaaggtcaccgtcctaggt [SEQ ID NO: 181]

tctagaggtggtggtggtagcggcggcggcggctctggtggtggtggatccctcgagatggcc [SEQ ID NO: 305]

**gaggtgcagctggtgcagtctggggggaggcgtggtacagcctggggggtccctgagactctcctgtgcagcctctggatt
cacctttgatgattatgccatgcactgggtccgtcaagctccagggaagggtctggagtgggtctctcttattagtgggga
tggtggtagcacatactatgcagactctgtgaagggccgattcaccatctccagagacaacagcaaaaactccctgtatc
tgcaaatgaacagtctgagaactgaggacaccgccttgtattactgtgcaaaagatcgggcagcagctggctactacta
ctacggtatggacgtctggggccaagggaccacggtcaccgtctcctca** [SEQ ID NO: 182]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSALTQPASVSGSPGQSITISCTGTSSDIGGYNYVSWYQQHPGKAPKLMIYDVSN
RPSGVSNRFSGSKSGNTASLTISGLQAEDEADYYCISYTRTWNPYVFGSGTKVTV
LG [SEQ ID NO: 183]

SRGGGGSGGGGSGGGGSLEMA [SEQ ID NO: 307]

**EVQLVQSGGGVVQPGGSLRLSCAASGFTFDDYAMHWVRQAPGKGLEWVSL
ISGDGGSTYYADSVKGRFTISRDNSKNSLYLQMNSLRTEDTALYYCAKDRAA
AGYYYYGMDVWGQGTTVTVSS** [SEQ ID NO: 184]

TSGQAGQHHHHHGAYPYDVPDYAS [SEQ ID NO: 308]

TABLE 47

ET200-097

DNA Sequence
(light chain variable region scFv linker heavy chain variable region His tag + HA tag)
ctgcctgtgctgactcagccaccctcagtgtccgtgtccccaggacagacagccatcatcacctgctctggagataaattggggg
aaaaatatgtttcctggtatcagcagaagccaggccagtcccctgtactggtcatcgatcaagataccaggaggccctcagggat
ccctgagcgattctctggctccaactctgggaccacagccactctgaccatcagcgggacccaggctatggatgaggctgacta
ttactgtcaggcgtgggacaggggtgtggtattcggcggagggaccaagctgaccgtcctaggt [SEQ ID NO: 185]

tctagaggtggtggtggtagcggcggcggcggctctggtggtggtggatccctcgagatggcc [SEQ ID NO: 305]

**gaggtgcagctggtggagtctgggggagacttggtacagcctggcaggtccctgagactctcctgtgcagcctctggatt
cacctttaatgattatgccatgcactgggtccggcaagctccagggaagggcctggagtgggtctcaggtattagttgga
gtggtaataacataggctatgcggactctgtgaagggccgattcaccatctccagagacaacgccaagaactccctgtat
ctgcaaatgaacagtctgagagctgaggacacggccttgtattactgtgcaaaagatagtataccggtatggcatcacctg
gggaggttttgactactggggccagggaaccctggtcaccgtctcctca** [SEQ ID NO: 186]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
LPVLTQPPSVSVSPGQTAIITCSGDKLGEKYVSWYQQKPGQSPVLVIDQDTRRPS
GIPERFSGSNSGTTATLTISGTQAMDEADYYCQAWDRGVVFGGGTKLTVLG
[SEQ ID NO: 187]

SRGGGGSGGGGSGGGGSLEMA [SEQ ID NO: 307]

**EVQLVESGGDLVQPGRSLRLSCAASGFTFNDYAMHWVRQAPGKGLEWVSG
ISWSGNNIGYADSVKGRFTISRDNAKNSLYLQMNSLRAEDTALYYCAKDSIR
YGITWGGFDYWGQGTLVTVSS** [SEQ ID NO: 188]

TSGQAGQHHHHHGAYPYDVPDYAS [SEQ ID NO: 308]

TABLE 48

ET200-098

DNA Sequence
(light chain variable region scFv linker heavy chain variable region His tag + HA tag)
cagcctgtgctgactcagccaccctcggtgtccaagggcttgagacagaccgccacactcacctgcactgggaacagcaacaa
tgttggcaacctaggagtagcttggctgcagcagcaccagggccaccctcccaaactcctatcctacaggaataacaaccggc
cctcagggatctcagagagattatctgcatccaggtcaggaaacacagcctccctgaccattactggactccagcctgaggacg
aggctgactattactgctcagcatgggacagtagcctcagtgcttgggtgttcggcggagggaccaagctgaccgtcctaggt
[SEQ ID NO: 189]

<u>tctagaggtggtggtggtagcggcggcggcggctctggtggtggtggatccctcgagatggcc</u> [SEQ ID NO: 305]

**gaggtgcagctggtggagtctgggggagtcgtggtacagcctggggggtccctgagactctcctgtgcagcctctggatt
cacctttgatgattatgccatgcactgggtccgtcaagctccggggaagggtctggagtgggtctctcttattaattgggat
ggtggtagcacctactatgcagactctgtgaagggtcgattcaccatctccagagacaacagcaaaaactccctgtatct
gcaaatgaacagtctgagagctgaggacaccgccttgtattactgtgcaaaaggatgggcctgagggcgtttgactac
tggggccagggaaccctggtcaccgtctcctca** [SEQ ID NO: 190]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QPVLTQPPSVSKGLRQTATLTCTGNSNNVGNLGVAWLQQHQGHPPKLLSYRNN
NRPSGISERLSASRSGNTASLTITGLQPEDEADYYCSAWDSSLSAWVFGGGTKLT
VLG [SEQ ID NO: 191]

<u>SRGGGGSGGGGSGGGGSLEMA</u> [SEQ ID NO: 307]

**EVQLVESGGVVVQPGGSLRLSCAASGFTFDDYAMHWVRQAPGKGLEWVSL
INWDGGSTYYADSVKGRFTISRDNSKNSLYLQMNSLRAEDTALYYCAKGMG
LRAFDYWGQGTLVTVSS** [SEQ ID NO: 192]

TSGQAGQHHHHHGAYPYDVPDYAS [SEQ ID NO: 308]

TABLE 49

ET200-099

DNA Sequence
(light chain variable region scFv linker heavy chain variable region His tag + HA tag)
cagtctgtgttgactcagccaccctcagcgtctgggaccccggggcagagggtcaccatctcctgttctggaagcagctccaac
atcggaagtaatactgtaaactggtaccagcagctcccaggaacggcccccaaactcctcatctatagtaatgatcagcggccct
caggggtccctgaccgattctctggctccaagtccggcacctcagcctcctggccatcagtgggctccagtctgaggatgagg
ctgattattactgtgcttcatgggatgacagcctgaatggccgttatgtcttcggaactgggaccaaggtcaccgtcctaggt
[SEQ ID NO: 193]

<u>tctagaggtggtggtggtagcggcggcggcggctctggtggtggtggatccctcgagatggcc</u> [SEQ ID NO: 305]

**caggtccagctggtacagtctgggggctgaggtgaggaagcctggggcctcagtgaaggtttcctgcaagacttctggat
acaccttcagttggtatgctatacattgggtgcgccaggcccccggacaaaggcttgagtggatgggatggatcaacgct
ggcaatggaaacacaaaatattcacagaaatttcagggcagagtcagtcttaccagggacacatccgcgagcacagcc
tacatggagctgagcagcctgagatctgatgacacggctgtgtattactgtgcgagacccgataattatggttcgggtgg
ggatgttttgatatctggggccaagggacaatggtcaccgtctcttca** [SEQ ID NO: 194]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSASGTPGQRVTISCSGSSSNIGSNTVNWYQQLPGTAPKLLIYSNDQRP
SGVPDRFSGSKSGTSASLAISGLQSEDEADYYCASWDDSLNGRYVFGTGTKVTV
LG [SEQ ID NO: 195]

<u>SRGGGGSGGGGSGGGGSLEMA</u> [SEQ ID NO: 307]

**QVQLVQSGAEVRKPGASVKVSCKTSGYTFSWYAIHWVRQAPGQRLEWMG
WINAGNGNTKYSQKFQGRVSLTRDTSASTAYMELSSLRSDDTAVYYCARPD
NYGSGGDVFDIWGQGTMVTVSS** [SEQ ID NO: 196]

TSGQAGQHHHHHGAYPYDVPDYAS [SEQ ID NO: 308]

TABLE 50

ET200-100

DNA Sequence
(light chain variable region scFv linker heavy chain variable region His tag + HA tag)
aattttatgctgactcagccccactctgtgtcggagtctccggggaagacggtaaccatctcctgcacccgcagcagtggcagca
ttgccagcaactttgtgcagtggtaccagcagcgcccgggcagtgccccacccctatgatctatgaggataacaacagacccc
ctgggggtccctgatcggttctctgcctccgtcgacagctcctccaactctgctccctcaccatctctggactgaagactgaggac
gaggctgactactactgtcagtcttatgataccagcaatgtggtattcggcggggggaccaagctgaccgtcctaggt [SEQ
ID NO: 197]

<u>tctagaggtggtggtggtagcggcggcggcggctctggtggtggtggatccctcgagatggcc</u> [SEQ ID NO: 305]

**gaggtgcagctggtggagtctgggggaggcttggtacagcctggagggtccctgagactctcctgtgcagcctctggatt
caccttcagtagttatgaaatgaactgggtccgccaggctccagggaaggggctggagtgggtttcatacattagtagta
gtggtagtaccatatactacgcagactctgtgaagggccgattcaccatctccagagacaacgccaagaactcactgtat
ctgcaaatgaacagcctgagagccgaggacacggctgtttattactgtgcacgctgggactacggtatggacgtctggg
gccaagggaccacggtcaccgtctcctca** [SEQ ID NO: 198]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
NFMLTQPHSVSESPGKTVTISCTRSSGSIASNFVQWYQQRPGSAPTPMIYEDNNRP
PGVPDRFSASVDSSSNSASLTISGLKTEDEADYYCQSYDTSNVVFGGGTKLTVLG
[SEQ ID NO: 199]

<u>SRGGGGSGGGGSGGGGSLEMA</u> [SEQ ID NO: 307]

**EVQLVESGGGLVQPGGSLRLSCAASGFTFSSYEMNWVRQAPGKGLEWVSYI
SSSGSTIYYADSVKGRFTISRDNAKNSLYLQMNSLRAEDTAVYYCARWDYG
MDVWGQGTTVTVSS** [SEQ ID NO: 200]

TSGQAGQHHHHHGAYPYDVPDYAS [SEQ ID NO: 308]

TABLE 51

ET200-101

DNA Sequence
(light chain variable region scFv linker heavy chain variable region His tag +
HA tag)
caggctgtgctgactcagccaccctcagcgtctggggccccgggcagagggtcaccgtctcttgttctggaagcaactccaac
atcggaagtaactacgttaactggtaccagcagttcccaggaacggccccccaaactcctcatgtatagtagtagtcagcggccct
cagggggtccctgaccgattctctggctccaagtctggcacctcagcctccctggccatcagtgggctccactctgaggatgagg
ctgattattactgtgctacatgggatgacagcctgaatgcttgggtgttcggcggagggaccaagctgaccgtcctaggt [SEQ
ID NO: 201]

<u>tctagaggtggtggtggtagcggcggcggcggctctggtggtggtggatccctcgagatggcc</u> [SEQ ID NO: 305]

**gaggtccagctggtgcagtctggggctgaggtgaggaagcctggggcctcagtgaaggtttcctgcaagacttctggat
acaccttcacttggtatgctatacattgggtgcgccaggcccccggacaaaggcttgagtggatgggatggatcaacgct
ggcagtggaaacacaaaatattcacagaaatttcagggcagagtcaccctaccagggacacatccgcgagcacagcg
tacatggagctgagcagcctgagatctgatgacacggctgtgtattactgtgcgagacccaataactatggttcgggtgg
ggatgttttgatatctggggccaagggacaatggtcaccgtctcttca** [SEQ ID NO: 202]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
QAVLTQPPSASGAPGQRVTVSCSGSNSNIGSNYVNWYQQFPGTAPKLLMYSSSQ
RPSGVPDRFSGSKSGTSASLAISGLHSEDEADYYCATWDDSLNAWVFGGGTKLT
VLG [SEQ ID NO: 203]

<u>SRGGGGSGGGGSGGGGSLEMA</u> [SEQ ID NO: 307]

**EVQLVQSGAEVRKPGASVKVSCKTSGYTFTWYAIHWVRQAPGQRLEWMG
WINAGSGNTKYSQKFQGRVTLTRDTSASTAYMELSSLRSDDTAVYYCARPN
NYGSGGDVFDIWGQGTMVTVSS** [SEQ ID NO: 204]

TSGQAGQHHHHHGAYPYDVPDYAS [SEQ ID NO: 308]

TABLE 52

ET200-102

DNA Sequence
(light chain variable region scFv linker heavy chain variable region His tag + HA tag)
cagtctgtcgtgacgcagccgccctcagtgtctgcggccccaggacagaaggtcaccatctcctgctctggaagcagctccaa
cattgggaataattatgtatcctggtaccagcagctcccaggaacagcccccaaactcctcatttatgacaataataagcgaccct
cagggattcctgaccgattctctggctccaagtctggcacgtcagccaccctgggcatcaccggactccagactggggacgag
gccgattattactgcgggaacatgggatagcagcctgagtgcttatgtcttcggaactgggaccaaggtcaccgtcctaggt
[SEQ ID NO: 205]

<u>tctagaggtggtggtggtagcggcggcggcggctctggtggtggtggatccctcgagatggcc</u> [SEQ ID NO: 305]

**caggtccagctggtgcagtctggggctgaggtgaagaagcctggggcctcagtgaaagtttcctgcaaggcttctggat
acaccttcacgaactatgctctgcattgggtgcgccaggcccccggacaagggcttgagtggatggcatggatcaacgg
tggcaatggtaacacaaaatattcacagaacttcagggcagagtcaccattaccagggacacatccgcgagcacagc
ctatatggagctgagcagcctgagatctgaagacacggccgtgtattactgtgcgaaacggaggaaacagctggaac
aatccactttgactactggggccagggaaccccggtcaccgtctcctca** [SEQ ID NO: 206]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
QSVVTQPPSVSAAPGQKVTISCSGSSSNIGNNYVSWYQQLPGTAPKLLIYDNNKR
PSGIPDRFSGSKSGTSATLGITGLQTGDEADYYCGTWDSSLSAYVFGTGTKVTVL
G [SEQ ID NO: 207]

<u>SRGGGGSGGGGSGGGGSLEMA</u> [SEQ ID NO: 307]

**QVQLVQSGAEVKKPGASVKVSCKASGYTFTNYALHWVRQAPGQGLEWMA
WINGGNGNTKYSQNFQGRVTITRDTSASTAYMELSSLRSEDTAVYYCAKPEE
TAGTIHFDYWGQGTPVTVSS** [SEQ ID NO: 208]

TSGQAGQHHHHHGAYPYDVPDYAS [SEQ ID NO: 308]

TABLE 53

ET200-103

DNA Sequence
(light chain variable region scFv linker heavy chain variable region His tag + HA tag)
caggctgtgctgactcagccccactctgtgtcggagtctccggggaagacggtaaccatctcctgcacccgcagcagtggcag
cattgccagcaactatgtgcagtggtaccagcagcgcccgggcagtgcccccaccactgtgatctatgaggataaccaaagac
cctctggggtccctgatcggttctctggctccatcgacagctcctccaactctgcctccctcaccatctctggactgaagactgag
gacgaggctgactactactgtcagtcttatgatagcaccatcacggtgttcggcggagggaccaagctgaccgtcctaggt
[SEQ ID NO: 209]

<u>tctagaggtggtggtggtagcggcggcggcggctctggtggtggtggatccctcgagatggcc</u> [SEQ ID NO: 305]

**caggtccagctggtacagtctggggctgaggtgaagaagcctgggtcctcggtgaaggtctcctgcaaggcttctggag
gcaccttcagcagctatgctatcagctgggtgcgacaggcccctggacaagggcttgagtggatgggagggatcatccc
tatctttggtacagcaaactacgcacagaagttccagggcagagtcacgattaccgcggacgaatccacgagcacagc
ctacatggagctgagcagcctgagatctgaggacacggccgtgtattactgtgcgggggagggttactatgatagtagt
ggttattccaacggtgatgcttttgatatctggggccaagggacaatggtcaccgtctcttca** [SEQ ID NO: 210]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
QAVLTQPHSVSESPGKTVTISCTRSSGSIASNYVQWYQRPGSAPTTVIYEDNQRP

TABLE 53-continued

ET200-103

SGVPDRFSGSIDSSSNSASLTISGLKTEDEADYYCQSYDSTITVFGGGTKLTVLG
[SEQ ID NO: 211]

<u>SRGGGGSGGGGSGGGGSLEMA</u> [SEQ ID NO: 307]

**QVQLVQSGAEVKKPGSSVKVSCKASGGTFSSYAISWVRQAPGQGLEWMGGI
IPIFGTANYAQKFQGRVTITADESTSTAYMELSSLRSEDTAVYYCAGEGYYDS
SGYSNGDAFDIWGQGTMVTVSS** [SEQ ID NO: 212]

TSGQAGQHHHHHHGAYPYDVPDYAS [SEQ ID NO: 308]

TABLE 54

ET200-104

DNA Sequence
(light chain variable region scFv linker heavy chain variable region His tag +
HA tag)
aattttatgctgactcagcccactctgtgtcggagtctccggggaagacggtaaccatctcctgcacccgcagcagtggcagca
ttgccagcaactatgtgcagtggtaccagcagcgcccgggcagtgccccaccactgtgatctatgaggataaccaaagaccct
ctggggtccctgatcggttctctggctccatcgacagctcctccaactctgcctccctcaccatctctggactgaagactgaggac
gaggctgactactactgtcagtcttatgatagcagcaatgtggtattcggcggagggaccaaggtcaccgtcctaggt [SEQ
ID NO: 213]

<u>tctagaggtggtggtggtagcggcggcggcggctctggtggtggtggatccctcgagatggcc</u> [SEQ ID NO: 305]

**gaggtgcagctggtggagtctgggggaggcttggtacagcctggagggtccctgagactctcctgtgcagcctctggatt
caccttcagtagttatgaaatgaactgggtccgccaggctcagggaaggggctggagtgggtttcatacattagtagta
gtggtagtaccatatactacgcagactctgtgaagggccgattcaccatctccagagacaacgccaagaactcactgtat
ctgcaaatgaacagcctgagagccgaggacacggctgtttattactgtgcacgctgggactacggtatggacgtctggg
gccaagggaccacggtcaccgtctcctca** [SEQ ID NO: 214]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSSNVVFGGGTKVTVLG
[SEQ ID NO: 215]

<u>SRGGGGSGGGGSGGGGSLEMA</u> [SEQ ID NO: 307]

**EVQLVESGGGLVQPGGSLRLSCAASGFTFSSYEMNWVRQAPGKGLEWVSYI
SSSGSTIYYADSVKGRFTISRDNAKNSLYLQMNSLRAEDTAVYYCARWDYG
MDVWGQGTTVTVSS** [SEQ ID NO: 216]

TSGQAGQHHHHHHGAYPYDVPDYAS [SEQ ID NO: 308]

TABLE 55

ET200-105

DNA Sequence
(light chain variable region scFv linker heavy chain variable region His tag +
HA tag)
tcctatgtgctgactcagccaccctcagtgtccgtgtccccaggacagacagccagcatcacctgctctggagatagattgacga
ataaatatgtttcctggtatcaacagaagccaggccagtcccctgtgttggtcatctatgaggatgccaagcggccctcagggatc
cctgcgcgattctctggctccaactctgggaacacagccactctgaccatcagcgggacccaggctatggatgagtctgaatatt
actgtcaggcgtgggacagcagtgtggtggttttggcggagggaccaagctgaccgtcctaggt [SEQ ID NO: 217]

<u>tctagaggtggtggtggtagcggcggcggcggctctggtggtggtggatccctcgagatggcc</u> [SEQ ID NO: 305]

**gaggtgcagctggtggagtctgggggaggcttggtacagcctggcaggtccctgagactctcctgtgcagcctctggatt
taccttttgatgattatgccatgcactgggtccggcaagctcagggaaggggctggagtgggtctcaggtattagttgga
atagtggtagtataggctatcggactctgtgaagggccgattcaccatctccagagacaacgccaagaactccctgtat
ctgcaaatgaacagtctgagagatgaggacacggcctgtattactgtcaaaagaccgagggggggagttatcgtta
aggatgcttttgatatctggggccaagggacaatggtcaccgtctcttca** [SEQ ID NO: 218]

TABLE 55-continued

ET200-105

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
SYVLTQPPSVSVSPGQTASITCSGDRLTNKYVSWYQQKPGQSPVLVIYEDAKRPS
GIPARFSGSNSGNTATLTISGTQAMDESEYYCQAWDSSVVVFGGGTKLTVLG
[SEQ ID NO: 219]

<u>SRGGGGSGGGGSGGGGSLEMA</u> [SEQ ID NO: 307]

**EVQLVESGGGLVQPGRSLRLSCAASGFTFDDYAMHWVRQAPGKGLEWVSG
ISWNSGSIGYADSVKGRFTISRDNAKNSLYLQMNSLRDEDTALYYCAKDRGG
GVIVKDAFDIWGQGTMVTVSS** [SEQ ID NO: 220]

TSGQAGQHHHHHHGAYPYDVPDYAS [SEQ ID NO: 308]

TABLE 56

ET200-106

DNA Sequence
(light chain variable region scFv linker heavy chain variable region His tag +
HA tag)
tcctatgagctgactcagccacccgcagcgtctgggaccccggacagagagtcaccatctcttgttctggggcgtctccaac
atcgggagtggtgctctaaattggtaccagcaactcccaggaacggcccccaaactcctcatctatagttacaatcagcggccct
caggggtctctgaccgattctctggctccaggtctgccacctcagcctccctggccatcagtgggctccagtctgaggatgaggc
tgattattactgtgcaacctgggatgatagtgtgaatggttgggtgttcggcggagggaccaagctgaccgtcctaggt [SEQ
ID NO: 221]

<u>tctagaggtggtggtggtagcggcggcggcggctctggtggtggtggatccctcgagatggcc</u> [SEQ ID NO: 305]

**gaggtgcagctggtggagtctggagctgaggtgaagaagcctggggattcagtgaaggtctcctgcaagccttctggtt
acaatttctctcaactatggtatcaactgggtgcgacaggcccctggacaagggcttgagtggatgggatggattagcact
tacaccggtaacacaaactatgcacagaagctgcagggcagagtcaccttcaccacagacacatccacgagcacagcc
tacatggagatgaggagcctgagatctgacgacacggccgtgtattactgtgcgcgccagcagggtggtggttggtacg
atgtttggggtcaaggtactctggtcaccgtctcctca** [SEQ ID NO: 222]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
SYELTQPPAASGTPGQRVTISCSGGVSNIGSGALNWYQQLPGTAPKLLIYSYNQR
PSGVSDRFSGSRSATSASLAISGLQSEDEADYYCATWDDSVNGWVFGGGTKLTV
LG [SEQ ID NO: 223]

<u>SRGGGGSGGGGSGGGGSLEMA</u> [SEQ ID NO: 307]

**EVQLVESGAEVKKPGDSVKVSCKPSGYNFLNYGINWVRQAPGQGLEWMG
WISTYTGNTNYAQKLQGRVTFTTDTSTSTAYMEMRSLRSDDTAVYYCARQQ
GGGWYDVWGQGTLVTVSS** [SEQ ID NO: 224]

TSGQAGQHHHHHHGAYPYDVPDYAS [SEQ ID NO: 308]

TABLE 57

ET200-107

DNA Sequence
(light chain variable region scFv linker heavy chain variable region His tag +
HA tag)
cagtctgtcgtgacgcagccgccctcagtgtctgcggccccaggagagaaggtcaccatctcctgctctggaagcaacttcaat
gttggaaataatgatgtatcctggtatcagcaactcccaggtgcagcccccaaactcctcatttatgacaataataagcgaccctca
gggattcctgaccgattctctggctccaagtctggcacgtcagccaccctggacatcaccgggctccacagtgacgacgaggc

TABLE 57-continued

ET200-107 cgattattactgcggaacatgggatagcagcctgaatactggggggtcttcggaactgggaccaaggtcaccgtcctaggt [SEQ ID NO: 225]

<u>tctagaggtggtggtggtagcggcggcggcggctctggtggtggtggatccctcgagatggcc</u> [SEQ ID NO: 305]

**gaggtccagctggtgcagtctggagctgaggtgaagaagcctggggcctcagtgaaggtctcctgcaaggcttctggtt
acacctttaccagctatactatcagctgggtacgacaggcccctggacaagggcttgagtggatgggatggatcagcac
ttacaatggtctcacaaactatgcacagaacctccagggcagagtcaccatgactacagacacattcacgaccacagcc
tacatggagctgaggagcctcagatctgacgacacggccgtgtattactgtgtgagagaggggtcccccgactacggtg
acttcgcgtcctttgactactggggccagggaacctggtcaccgtctcctca** [SEQ ID NO: 226]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
QSVVTQPPSVSAAPGEKVTISCSGSNFNVGNNDVSWYQQLPGAAPKLLIYDNNK
RPSGIPDRFSGSKSGTSATLDITGLHSDDEADYYCGTWDSSLNTGGVFGTGTKVT
VLG [SEQ ID NO: 227]

<u>SRGGGGSGGGGSGGGGSLEMA</u> [SEQ ID NO: 307]

**EVQLVQSGAEVKKPGASVKVSCKASGYTFTSYTISWVRQAPGQGLEWMGW
ISTYNGLTNYAQNLQGRVTMTTDTFTTTAYMELRSLRSDDTAVYYCVREGS
PDYGDFASFDYWGQGTLVTVSS** [SEQ ID NO: 228]

TSGQAGQHHHHHHGAYPYDVPDYAS [SEQ ID NO: 308]

TABLE 58

ET200-108

DNA Sequence
(light chain variable region scFv linker heavy chain variable region His tag +
HA tag)
cagtctgtgttgacgcagccgccctcagtgtctgcgccccgggacagaaggtcaccatctcctgctctggaagcagctccaac
attgggaataattatgtatcctggtaccagcagttcccaggaacagcccccaaactcctcatttatgacaataataagcgaccctca
gggatttctgaccgattctctggctccaagtctggcacgtcagccaccctgggcatcgccggactccagactggggacgaggc
cgattattactgcggaacatgggataccagcctgagtggttttatgtcttcggaagtgggaccaaggtcaccgtcctaggt [SEQ ID NO: 229]

<u>tctagaggtggtggtggtagcggcggcggcggctctggtggtggtggatccctcgagatggcc</u> [SEQ ID NO: 305]

**gaggtccagctggtacagtctggagctgaggtgaagaagcctggggcctcagtgaaggtctcctgcaaggcttctggtt
acacctttaccagctatactatcagctgggtacgacaggcccctggacaagggcttgagtggatgggatggatcagcac
ttacaatggtctcacaaactatgcacagaacctccagggcagagtcaccatgactacagacacattcacgaccacagcc
tacatggagctgaggagcctcagatctgacgacacggccgtgtattactgtgtgagagaggggtcccccgactacggtg
acttcgcgtcctttgactactggggccagggaacctggtcaccgtctcctca** [SEQ ID NO: 230]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
QSVLTQPPSVSAPPGQKVTISCSGSSSNIGNNYVSWYQQFPGTAPKLLIYDNNKRP
SGISDRFSGSKSGTSATLGIAGLQTGDEADYYCGTWDTSLSGFYVFGSGTKVTVL
G [SEQ ID NO: 231]

<u>SRGGGGSGGGGSGGGGSLEMA</u> [SEQ ID NO: 307]

**EVQLVQSGAEVKKPGASVKVSCKASGYTFTSYTISWVRQAPGQGLEWMGW
ISTYNGLTNYAQNLQGRVTMTTDTFTTTAYMELRSLRSDDTAVYYCVREGS

PDYGDFASFDYWGQGTLVTVSS** [SEQ ID NO: 232]

TSGQAGQHHHHHHGAYPYDVPDYAS [SEQ ID NO: 308]

TABLE 59

ET200-109

DNA Sequence
(light chain variable region scFv linker heavy chain variable region His tag +
HA tag)
ctgcctgtgctgactcagccaccctcagcgtctgcgaccccggggcagagggtcaccatctcttgttctggaaccacctccaaca
tcggaagtaatactgtacactggtaccagcagctcccagggacgccccaaactcctcatctataataataatcagcggccctc
aggggtccctgaccgattctctggctccaagtctggcacctcagcctccctggccatcagtgggctccggtccgaggatgaggc
tacatattcctgtgcaacatgggatgacagcctgagtggtgtggtcttcggcggagggaccaagctgaccgtcctaggt [SEQ
ID NO: 233]

<u>tctagaggtggtggtggtagcggcggcggcggctctggtggtggtggatccctcgagatggcc</u> [SEQ ID NO: 305]

**gaggtccagctggtgcagtctggggctgaggtgaagaagcctggggtcctcggtgaaggtctcctgcaaggcttctggag
gcaccttcagcagctatgctatcagctgggtgcgacaggcccctggacaagggcttgagtggatgggagggatcatccc
tatctttggtacagcaaactacgcacagaagttccagggcagagtcacgattaccgcggacgaatccacgagcacagc
ctacatggagctgagcagcctgagatctgaggacacggccgtgtattactgtgcgagagatcccgctacggtgactac
gagtatgatgcttttgatatctggggccaagggacaatggtcaccgtctcttca** [SEQ ID NO: 234]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
LPVLTQPPSASATPGQRVTISCSGTTSNIGSNTVHWYQQLPGTAPKLLIYNNNQRP
SGVPDRFSGSKSGTSASLAISGLRSEDEATYSCATWDDSLSGVVFGGGTKLTVLG
[SEQ ID NO: 235]

<u>SRGGGGSGGGGSGGGGSLEMA</u> [SEQ ID NO: 307]

**EVQLVQSGAEVKKPGSSVKVSCKASGGTFSSYAISWVRQAPGQGLEWMGGI
IPIFGTANYAQKFQGRVTITADESTSTAYMELSSLRSEDTAVYYCARDPAYGD
YEYDAFDIWGQGTMVTVSS** [SEQ ID NO: 236]

TSGQAGQHHHHHGAYPYDVPDYAS [SEQ ID NO: 308]

TABLE 60

ET200-110

DNA Sequence
(light chain variable region scFv linker heavy chain variable region His tag +
HA tag)
cagtctgtgttgacgcagccgccctcagcgtctgggaccccggggcagagggtcaccatctcttgttctggaagcagctccaac
atcggaactaatggtgtaaactggttccagcagttcccaggaacggcccccaaactcctcatctatactaatgatcagcggccctc
aggggtccctgaccgattctctggctccaagtctggcacctcagcctccctggccatcagtgggctccagtctgcggatgaggct
gattattactgtgcagtgtgggaccacagcctgaatggtccggtgttcggcggagggaccaagctgaccgtcctaggt [SEQ
ID NO: 237]

<u>tctagaggtggtggtggtagcggcggcggcggctctggtggtggtggatccctcgagatggcc</u> [SEQ ID NO: 305]

**caggtgcagctggtgcagtctggggctgaggtgaagaagcctggggtcctcggtgaaggtctcctgcaaggcttctggag
gcaccttcagcagctatgctatcagctgggtgcgacaggcccctggacaagggcttgagtggatgggagggatcatccc
tatctttggtacagcaaactacgcacagaagttccagggcagagtcacgattaccgcggacgaatccacgagcacagc
ctacatggagctgagcagcctgagatctgaggacacggccgtgtattactgtgcgagaggggccggttttgatgcttttg
atatctggggccaagggacaatggtcaccgtctcttca** [SEQ ID NO: 238]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
QSVLTQPPSASGTPGQRVTISCSGSSSNIGTNGVNWFQQFPGTAPKLLIYTNDQRP
SGVPDRFSGSKSGTSASLAISGLQSADEADYYCAVWDHSLNGPVFGGGTKLTVL
G [SEQ ID NO: 239]

<u>SRGGGGSGGGGSGGGGSLEMA</u> [SEQ ID NO: 307]

**QVQLVQSGAEVKKPGSSVKVSCKASGGTFSSYAISWVRQAPGQGLEWMGGI
IPIFGTANYAQKFQGRVTITADESTSTAYMELSSLRSEDTAVYYCARGAGFD
AFDIWGQGTMVTVSS** [SEQ ID NO: 240]

TSGQAGQHHHHHGAYPYDVPDYAS [SEQ ID NO: 308]

TABLE 61

ET200-111

DNA Sequence
(light chain variable region scFv linker heavy chain variable region His tag + HA tag)
caggctgtgctgactcagccaccctcagcgtctggaccccggggcagagggtcaccatctcttgttctggaagcagctccaac
atcggaagtaatactgtaaactggtaccagcagctcccaggaacggccccaaactcctcatctatagtaataatcagcggccct
caggggtccctgaccgattctctggctccaagtctggcacctcagcctcctggccatcagtgggctccagtctgaggatgaga
ctgattattactgtgcagcatgggatgacagcctgaatggttatgtcttcggaactgggaccaaggtcaccgtcctaggt [SEQ ID NO: 241]

<u>tctagaggtggtggtggtagcggcggcggcggctctggtggtggtggatccctcgagatggcc</u> [SEQ ID NO: 305]

**caggtgcagctacagcagtggggcgcaggactgttgaagccttcggagaccctgtccctcacctgcgctgtctatggtgg
gtccttcagtggttactactggagctggatccgccagcccccagggaaggggctggagtggattggggaaatcaatcat
agtggaagcaccaactacaacccgtccctcaagagtcgagtcaccatatcagtagacacgtccaagaaccagttctccc
tgaagctgagctctgtgaccgccgcggacacggctgtgtattactgtgcgagagaggggctagatgcttttgatatctgg
ggccaagggacaatggtcaccgtctcttca** [SEQ ID NO: 242]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
QAVLTQPPSASGTPGQRVTISCSGSSSNIGSNTVNWYQQLPGTAPKLLIYSNNQRP
SGVPDRFSGSKSGTSASLAISGLQSEDETDYYCAAWDDSLNGYVFGTGTKVTVL
G [SEQ ID NO: 243]

<u>SRGGGGSGGGGSGGGGSLEMA</u> [SEQ ID NO: 307]

**QVQLQQWGAGLLKPSETLSLTCAVYGGSFSGYYWSWIRQPPGKGLEWIGEI
NHSGSTNYNPSLKSRVTISVDTSKNQFSLKLSSVTAADTAVYYCAREGLDAFD
IWGQGTMVTVSS** [SEQ ID NO: 244]

TSGQAGQHHHHHGAYPYDVPDYAS [SEQ ID NO: 308]

TABLE 62

ET200-112

DNA Sequence
(light chain variable region scFv linker heavy chain variable region His tag + HA tag)
caggctgtgctgactcagccaccctcagcgtctggaccccggggcagagggtcaccatctcttgttctggaagcagctccaac
atcggaagtaatactgtaaactggtaccagcagctcccaggaacggccccaaactcctcatgtatagtaatgatcagcggccct
caggggtccctgaccgattctctggctccaagtctggcacctcagcctcctggccatcagtgggctccagtctgaggatgagg
ctgattattattgtgcagcatgggatgacagcctgaatggttatgtcttcgcagctgggaccagctcaccgtttttaagt [SEQ ID NO: 245]

<u>tctagaggtggtggtggtagcggcggcggcggctctggtggtggtggatccctcgagatggcc</u> [SEQ ID NO: 305]

**caggtgcagctacagcagtggggcgcaggactgttgaagccttcggagaccctgtccctcacctgcgctgtctatggtgg
gtccttcagtggttactactggagctggatccgccagcccccagggaaggggctggagtggattggggaaatcaatcat
agtggaagcaccaactacaacccgtccctcaagagtcgagtcaccatatcagtagacacgtccaagaaccagttctccc
tgaagctgagctctgtgaccgccgcggacacggctgtgtattactgtgcgagagaggggctagatgcttttgatatctgg
ggccaagggacaatggtcaccgtctcttca** [SEQ ID NO: 246]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
QAVLTQPPSASGTPGQRVTISCSGSSSNIGSNTVNWYQQLPGTAPKLLMYSNDQR
PSGVPDRFSGSKSGTSASLAISGLQSEDEADYYCAAWDDSLNGYVFAAGTQLTV
LS [SEQ ID NO: 247]

<u>SRGGGGSGGGGSGGGGSLEMA</u> [SEQ ID NO: 307]

**QVQLQQWGAGLLKPSETLSLTCAVYGGSFSGYYWSWIRQPPGKGLEWIGEI
NHSGSTNYNPSLKSRVTISVDTSKNQFSLKLSSVTAADTAVYYCAREGLDAFD
IWGQGTMVTVSS** [SEQ ID NO: 248]

TSGQAGQHHHHHGAYPYDVPDYAS [SEQ ID NO: 308]

TABLE 63

ET200-113

DNA Sequence
(light chain variable region scFv linker heavy chain variable region His tag + HA tag)
cagtctgtcgtgacgcagccgccctcagtgtctgcggccccaggacagaaggtcaccatctcctgctctggaagcagctccaa
cattgggaataattatgtatcctggtaccagcagctcccaggaacagcccccaaactcctcatttatgacaataataagcgaccct
cagggattcctgaccgattctctggctccaagtctggcacgtcagccaccctgggcatcactggactccagactggggacgag
gccgattattactgcggaacatgggatagcagcctgagtgctgcttatgtcttcggaactgggaccaaggtcaccgtcctaggt
[SEQ ID NO: 249]

<u>tctagaggtggtggtggtagcggcggcggcggctctggtggtggtggatccctcgagatggcc</u> [SEQ ID NO: 305]

**caggtccagctggtacagtctggagctgaggtgaagaagcctggggcctcagtgaaggtctcctgcaaggcttctggtta
cagctttaccagctatactatcagctgggttcgacaggcccctggacaaggccttgagtggatgggatgggtcagcactt
acaatggtctcagaaactatgcacagaacctccagggcagagtcaccatgactacagacacactcacgaccacagcct
acatggagctgaggagcctcagatctgacgacacggccgtgtattattgtgtgagagaggggtcccccgactacggtga
cttcgcggcctttgactactggggccagggcaccctggtcaccgtctcctca** [SEQ ID NO: 250]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
QSVVTQPPSVSAAPGQKVTISCSGSSSNIGNNYVSWYQQLPGTAPKLLIYDNNKR
PSGIPDRFSGSKSGTSATLGITGLQTGDEADYYCGTWDSSLSAAYVFGTGTKVTV
LG [SEQ ID NO: 251]

<u>SRGGGGSGGGGSGGGGSLEMA</u> [SEQ ID NO: 307]

**QVQLVQSGAEVKKPGASVKVSCKASGYSFTSYTISWVRQAPGQGLEWMGW
VSTYNGLRNYAQNLQGRVTMTTDTLTTTAYMELRSLRSDDTAVYYCVREG
SPDYGDFAAFDYWGQGTLVTVSS** [SEQ ID NO: 252]

TSGQAGQHHHHHGAYPYDVPDYAS [SEQ ID NO: 308]

TABLE 64

ET200-114

DNA Sequence
(light chain variable region scFv linker heavy chain variable region His tag + HA tag)
caggctgtgctgactcagccaccctcagcgtctgagaccccggggcagagggtcaccatctcttgttctggaagcaggtccaac
atcggaactaatattgtacactggtaccagcagcgcccaggaatggcccccaaactcctcacttatggtagtcggcggccctca
ggggtccccgaccgattctctggctccaagtttggcacctcagcctccctggccatcagtgggctccagtctgaggatgaggct
gattattattgtgcagcatgggatgacagtctgaatggtccggctttcggcgagggaccaagctgaccgtcctaggt [SEQ
ID NO: 253]

<u>tctagaggtggtggtggtagcggcggcggcggctctggtggtggtggatccctcgagatggcc</u> [SEQ ID NO: 305]

**caggtgcagctacagcagtggggcgcaggactgttgaagccttcggagaccctgtcctcacctgcgctgtctatggtgg
gtccttcagtggttactactggagctggatccgccagcccccagggaaggggctggagtggattggggaaatcaatcat
agtggaagcaccaactacaacccgtccctcaagagtcgagtcaccatatcagtagacacgtccaagaaccagttctctcc
tgaagctgagtctgtgaccgccgcggacacggctgtgtattactgtgcgagagacggtgggggctactttgactactgg
ggccagggaaccctggtcaccgtctcctca** [SEQ ID NO: 254]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
QAVLTQPPSASETPGQRVTISCSGSRSNIGTNIVHWYQQRPGMAPKLLTYGSRRP
SGVPDRFSGSKFGTSASLAISGLQSEDEADYYCAAWDDSLNGPAFGGGTKLTVL
G [SEQ ID NO: 255]

<u>SRGGGGSGGGGSGGGGSLEMA</u> [SEQ ID NO: 307]

**QVQLQQWGAGLLKPSETLSLTCAVYGGSFSGYYWSWIRQPPGKGLEWIGEI
NHSGSTNYNPSLKSRVTISVDTSKNQFSLKLSSVTAADTAVYYCARDGGGYF
DYWGQGTLVTVSS** [SEQ ID NO: 256]

TSGQAGQHHHHHGAYPYDVPDYAS [SEQ ID NO: 308]

TABLE 65

ET200-115

DNA Sequence
(light chain variable region scFv linker heavy chain variable region His tag + HA tag)
cagtctgtgttgacgcagccgccctcagtgtctggggccccagggcagagggtcaccatctcctgcactgggagcagctccaa
tatcggggcacgttatgatgtacactggtaccagcaactcccaggaacagcccccgactcctcatctctgctaactacgatcgg
ccctcaggggtccctgaccgattctctggctccaagtctggcacctcagcctccctggccatcactgggctccaggctgaggat
gaggctgattattactgccagtcctatgacagcagtgtgagtgcttgggtgttcggcggagggaccaaggtcaccgtcctaggt
[SEQ ID NO: 257]

tctagaggtggtggtggtagcggcggcggcggctctggtggtggtggatccctcgagatggcc [SEQ ID NO: 305]

gaagtgcagctggtgcagtctggggctgaagtgaaggagcctggggcctcagtgaggatctcctgccaggcatctggat
acaacttcatcagttattatatgcactgggtgcggcaggcccctgggcaaggtcttgagtggatgggcaccatcaaccca
ggcagtggtgagacagactactcacagaagttgcagggcagagtcaccatgaccagggacccgtccacgggtacattc
gacatgggctgagcagcctgacatctggggacacggccgtctattattgtgcgacaggtctcatcagaggagctagcg
atgcttttaatatctggggccgggggacaatggtcaccgtctcttca [SEQ ID NO: 258]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy
chain variable region His tag + HA tag)
QSVLTQPPSVSGAPGQRVTISCTGSSSNIGARYDVHWYQQLPGTAPRLLISANYD
RPSGVPDRFSGSKSGTSASLAITGLQAEDEADYYCQSYDSSVSAWVFGGGTKVT
VLG [SEQ ID NO: 259]

SRGGGGSGGGGSGGGGSLEMA [SEQ ID NO: 307]

EVQLVQSGAEVKEPGASVRISCQASGYNFISYYMHWVRQAPGQGLEWMGT
INPGSGETDYSQKLQGRVTMTRDPSTGTFDMGLSSLTSGDTAVYYCATGLIR
GASDAFNIWGRGTMVTVSS [SEQ ID NO: 260]

TSGQAGQHHHHHHGAYPYDVPDYAS [SEQ ID NO: 308]

TABLE 66

ET200-116

DNA Sequence
(light chain variable region scFv linker heavy chain variable region His tag + HA tag)
cagcctgtgctgactcagccaccctcagtgtccgtgtccccaggacagacggccgccatcccctgttctggagataagttgggg
gataaatttgcttcctggtatcagcagaagccaggccagtcccctgtgctggtcatctatcaagatactaagcggccctcagggat
ccctgagcgattctctggctccaactctgggaacacagccactctgaccatcagcgggacccaggctatggatgaggctgacta
ttactgtcagacgtgggccagcggcattgtggtgttcggcggagggaccaagctgaccgtcctaggt [SEQ ID NO: 261]

tctagaggtggtggtggtagcggcggcggcggctctggtggtggtggatccctcgagatggcc [SEQ ID NO: 305]

caggtacagctgcagcagtcaggtccaggactggtgaagccctcgcagaccctctcactcacctgtgccatctccgggg
acagtgtctctagcaacagtgctgcttggaactggatcaggcagtccccatcgagggccttgagtggctgggaaggac
atactacaggtccaagtggtataatgattatgcagtatctgtgaaaagtcgaataaccatcaacccagacacatccaag
aaccagttctccctgcagctgaactctgtgactcccgaggacacggctgtgtattactgcaagagagcgcagtggctg
gaagggatttgactactggggccagggaaccctggtcaccgtctcctca [SEQ ID NO: 262]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QPVLTQPPSVSVSPGQTAAIPCSGDKLGDKFASWYQQKPGQSPVLVIYQDTKRPS
GIPERFSGSNSGNTATLTISGTQAMDEADYYCQTWASGIVVFGGGTKLTVLG
[SEQ ID NO: 263]

SRGGGGSGGGGSGGGGSLEMA [SEQ ID NO: 307]

QVQLQQSGPGLVKPSQTLSLTCAISGDSVSSNSAAWNWIRQSPSRGLEWLGR
TYYRSKWYNDYAVSVKSRITINPDTSKNQFSLQLNSVTPEDTAVYYCARERS
GWKGFDYWGQGTLVTVSS [SEQ ID NO: 264]

TSGQAGQHHHHHHGAYPYDVPDYAS [SEQ ID NO: 308]

TABLE 67

ET200-117

DNA Sequence
(light chain variable region scFv linker heavy chain variable region His tag + HA tag)
gatgttgtgatgactcagtctccaccctccctgtccgtcaccctggagagccggcctccatcacctgcaggtctagtcagagcct
cctggaaagaaatgcatacaactacttggattggtacctgcagaggccaggacagtctccacagctcctgatctacttgggttcta
atcgggccgccggggtccctgacaggttcagtggcagtggatcaggcagagattttacactgaaaatcagcagagtggagcct
gaggatgttggggtttattactgcatgcaagctctacaagctccgttcactttcggcggagggaccaaggtggagatcaaacgt
[SEQ ID NO: 265]

<u>tctagaggtggtggtggtagcggcggcggcggctctggtggtggtggatccctcgagatggcc</u> [SEQ ID NO: 305]

**gaagtgcagctggtgcagtctggggaggcttggtacagcctggggggtccctgagactctcctgtgcagcctctggatt
cacctttagcagctatgccatgagctgggtccgccaggctccagggaaggggctggagtgggtctcagctattagtggta
gtggtggtagcacatactacgcagactccgtgaagggccggttcaccatctccagagacaattccaagaacacgctgta
tctgcaaatgaacagcctgagagccgaggacacggccgtatattactgtgcgaaatggggcccgtttcaggatgcttttg
atatctggggccaagggacaatggtcaccgtctcttca** [SEQ ID NO: 266]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
DVVMTQSPPSLSVTPGEPASITCRSSQSLLERNAYNYLDWYLQRPGQSPQLLIYL
GSNRAAGVPDRFSGSGSGRDFTLKISRVEPEDVGVYYCMQALQAPFTFGGGTKV
EIKR [SEQ ID NO: 267]

<u>SRGGGGSGGGGSGGGGSLEMA</u> [SEQ ID NO: 307]

**EVQLVQSGGGLVQPGGSLRLSCAASGFTFSSYAMSWVRQAPGKGLEWVSAI
SGSGGSTYYADSVKGRFTISRDNSKNTLYLQMNSLRAEDTAVYYCAKWGPF
QDAFDIWGQGTMVTVSS** [SEQ ID NO: 268]

TSGQAGQHHHHHHGAYPYDVPDYAS [SEQ ID NO: 308]

TABLE 68

ET200-118

DNA Sequence
(light chain variable region scFv linker heavy chain variable region His tag + HA tag)
caggctgtgctgactcagcctgcctccgtgtctgggtctcctggacagtcgatcaccatctcctgcactggaaccagcagtgacg
ttggtggttataactatgtctcctggtaccaacagcacccgggcaaagcccccaaactcatgatttatgaggtcagtaatcggccc
tcaggggtttctaatcgcttctctggctccaagtctggcaacacggcctccctgaccatctctgggctccaggctgaggacgagg
ctgattattactgcagctcatatacaagcagcagcaccccttatgtcttcggagcagggaccaaggtcaccgtcctaggt [SEQ ID NO: 269]

<u>tctagaggtggtggtggtagcggcggcggcggctctggtggtggtggatccctcgagatggcc</u> [SEQ ID NO: 305]

**gaggtgcagctggtggagtctggggaggcttggtacagcctggcaggtccctgagactctcctgtgcagcctctggatt
cacctttgatgattatgccatgcactgggtccggcaagctccagggaaggggctggagtgggtctcaggtattagttgga
atagtggtagcataggctatgcggactctgtgaagggccgattcaccatctccagagacaacgccaagaactccctgtat
ctgcaaatgaacagtctgagagctgaggacacggcct tgtattactgtgcaaaagccaggtggacagcagtggcatca
gaccaccactttgactactggggccagggaacgctggtcaccgtctcctca** [SEQ ID NO: 270]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QAVLTQPASVSGSPGQSITISCTGTSSDVGGYNYVSWYQQHPGKAPKLMIYEVSN
RPSGVSNRFSGSKSGNTASLTISGLQAEDEADYYCSSYTSSSTPYVFGAGTKVTV
LG [SEQ ID NO: 271]

<u>SRGGGGSGGGGSGGGGSLEMA</u> [SEQ ID NO: 307]

**EVQLVESGGGLVQPGRSLRLSCAASGFTFDDYAMHWVRQAPGKGLEWVSG
ISWNSGSIGYADSVKGRFTISRDNAKNSLYLQMNSLRAEDTALYYCAKRW
TAVASDHHFDYWGQGTLVTVSS** [SEQ ID NO: 272]

TSGQAGQHHHHHHGAYPYDVPDYAS [SEQ ID NO: 308]

TABLE 69

ET200-119

DNA Sequence
(light chain variable region scFv linker heavy chain variable region His tag + HA tag)
caggctgtgcttactcagccaccctcagcgtctgggaccccgggcagagggtcaccatctcttgttctggaagcagctccaac
atcggaagtaatactgtaaactggtaccagcagctcccaggaacggcccccaaactcctcatctatagtaataatcagcggccct
caggggtccctgaccgattctctggctccaagtctggcacctcagcctcctggccatcagtgggctccagtctgaggatgagg
ctgattattactgtgcagcatgggatgacagcctgaatggttatgtcttcggaactgggaccaagctgaccgtcctaggt [SEQ ID NO: 273]

<u>tctagaggtggtggtggtagcggcggcggcggctctggtggtggtggatccctcgagatggcc</u> [SEQ ID NO: 305]

**gaggtgcagctggtgcagtctggggctgaggtgaagaagcctggggtcctcggtgaaggtctcctgcaaggcttctggag
gcaccttcagcagctatgctatcagctgggtgcgacaggcccctggacaagggcttgagtggatgggagggatcatccc
tatctttggtacagcaaactacgcacagaagttccagggcagagtcacgattaccgcggacgaatccacgagcacagc
ctacatggagctgagcagcctgagatctgaggacacggccgtgtattactgtgcgagagattgggactacatggacgtc
tggggcaaagggaccacggtcaccgtctcctca** [SEQ ID NO: 274]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QAVLTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYVFGTGTKLTVL
G [SEQ ID NO: 275]

<u>SRGGGGSGGGGSGGGGSLEMA</u> [SEQ ID NO: 307]

**EVQLVQSGAEVKKPGSSVKVSCKASGGTFSSYAISWVRQAPGQGLEWMGGI
IPIFGTANYAQKFQGRVTITADESTSTAYMELSSLRSEDTAVYYCARDWDYM
DVWGKGTTVTVSS** [SEQ ID NO: 276]

TSGQAGQHHHHHGAYPYDVPDYAS [SEQ ID NO: 308]

TABLE 70

ET200-120

DNA Sequence
(light chain variable region scFv linker heavy chain variable region His tag + HA tag)
tcctatgagctgactcagccaccctcagcgtctgggaccccgggcagagggtcaccatctcttgttctggaagcagctccaac
atcggaagtaatactgtaaactggtaccagcagctcccaggaacggcccccaaactcctcatctatagtaataatcagcggccct
caggggtccctgaccgattctctggctccaagtctggcacctcagcctcctggccatcagtgggctccagtctgaggatgagg
ctgattattactgtgcagcatgggatgacagcctgaatggttatgtcttcggaactgggaccaaggtcaccgtcctaggt [SEQ ID NO: 277]

<u>tctagaggtggtggtggtagcggcggcggcggctctggtggtggtggatccctcgagatggcc</u> [SEQ ID NO: 305]

**gaggtgcagctggtggagtctggagctgaggtgaagaagcctggggcctcagtgaaggtctcctgcaaggcttctggtt
acacctttaccagctatggtatcagctgggtgcgacaggcccctggacaagggcttgagtggatgggatggatcagcgc
ttacaatggtaacacaaactatgcacagaagctccagggcagagtcaccatgaccacagacacatccacgagcacagc
ctacatggagctgaggagcctgagatctgacgacacggccgtgtattactgtgcgagagacctatctcggggagctaac
ccgcattactactactacggtatggacgtctgggggcaagggaccacggtcaccgtctcctca** [SEQ ID NO: 278]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
SYELTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYVFGTGTKVTVL
G [SEQ ID NO: 279]

<u>SRGGGGSGGGGSGGGGSLEMA</u> [SEQ ID NO: 307]

**EVQLVESGAEVKKPGASVKVSCKASGYTFTSYGISWVRQAPGQGLEWMGW
ISAYNGNTNYAQKLQGRVTMTTDTSTSTAYMELRSLRSDDTAVYYCARDLS
RGANPHYYYYGMDVWGQGTTVTVSS** [SEQ ID NO: 280]

TSGQAGQHHHHHGAYPYDVPDYAS [SEQ ID NO: 308]

TABLE 71

ET200-121

DNA Sequence
(light chain variable region scFv linker heavy chain variable region His tag + HA tag)
cagtctgtgttgacgcagccgccctcagtgtctggggccccagggcagagggtcaccgtctcctgcactgggagcagatccaa
catcggggcaggatatgatgtacactggtaccagcaacttccaggaacagcccccaaactcctcatctatggaaatagtaatcgg
cctccaggggtccctgaccgattctctgggtctaagtctggcacctcagcctccctggtcatcactgggctccaggctgaggatg
ccgctgattattactgccagtcctatgacaacactgtgcgtaatcaccttatgtcttcggaactgggaccaaggtcaccgtcctag
gt [SEQ ID NO: 281]

<u>tctagaggtggtggtggtagcggcggcggcggctctggtggtggtggatccctcgagatggcc</u> [SEQ ID NO: 305]

**gaggtccagctggtacagtctggggctgaggtgaagaagcctggggcctcagtgaaggtctcctgcaaggtttccggat
acaccctcactgaattatccatgcactgggtgcgacaggctcctggaaaagggcttgagtggatgggaggttttgatcct
gaagatggtgaaacaatctacgcacagaagttccagggcagagtcaccatgaccgaggacacatctacagacacagc
ctacatggagctgagcagcctgagatctgaggacacggccgtgtattactgtgcaacagagagtaatttagtgtcccggc
actactactactacggtatggacgtctggggccaagggaccacggtcaccgtctcctca** [SEQ ID NO: 282]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QSVLTQPPSVSGAPGQRVTVSCTGSRSNIGAYDVHWYQQLPGTAPKLLIYGNS
NRPPGVPDRFSGSKSGTSASLVITGLQAEDAADYYCQSYDNTVRESPYVFGTGTK
VTVLG [SEQ ID NO: 283]

<u>SRGGGGSGGGGSGGGGSLEMA</u> [SEQ ID NO: 307]

**EVQLVQSGAEVKKPGASVKVSCKVSGYTLTELSMHWVRQAPGKGLEWMG
GFDPEDGETIYAQKFQGRVTMTEDTSTDTAYMELSSLRSEDTAVYYCATESN
LVSRHYYYYGMDVWGQGTTVTVSS** [SEQ ID NO: 284]

TSGQAGQHHHHHHGAYPYDVPDYAS [SEQ ID NO: 308]

TABLE 72

ET200-122

DNA Sequence
(light chain variable region scFv linker heavy chain variable region His tag + HA tag)
ctgcctgtgctgactcagccaccctcagcgtctggaccccggggcagagggtcaccatctcttgttctggaaccagctccaac
atcggaagtaattctgtagactggtaccagcagctcccaggaacggcccccaaactcctcatctatagtaataatcagcggccct
caggggtccctgaccgaatctctggctccaagtctggcacctcagcctccctggccatcagtgggctccagtctgaggatgagg
ctgattattactgtgcagcatgggatgacagcctgaatggttatgtcttcggaactgggaccaaggtcaccgtcctaggt [SEQ
ID NO: 285]

<u>tctagaggtggtggtggtagcggcggcggcggctctggtggtggtggatccctcgagatggcc</u> [SEQ ID NO: 305]

**gaagtgcagctggtgcagtctggggctgaggtgaagaagcctggggcctcagtgaaggtctcctgcaaggcttctggat
acaccttcaccggctactatatgcactgggtgcgacaggcccctggacaagggcttgagtggatgggatggatcaaccc
taacagtggtggcacaaactatgcacagaagtttcagggcagggtcaccatgaccagggacacgtccatcagcacagc
ctacatggagctgagcaggctgagatctgacgacacggccgtgtattactgtgcgagagattacggatactatggttcgg
ggagttattcgagcggccccctttactactactacggtatggacgtctggggccaagggaccacggtcaccgtctcctca**
[SEQ ID NO: 286]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
LPVLTQPPSASGTPGQRVTISCSGTSSNIGSNSVDWYQQLPGTAPKLLIYSNNQRP
SGVPDRISGSKSGTSASLAISGLQSEDEADYYCAAWDDSLNGYVFGTGTKVTVL
G [SEQ ID NO: 287]

<u>SRGGGGSGGGGSGGGGSLEMA</u> [SEQ ID NO: 307]

**EVQLVQSGAEVKKPGASVKVSCKASGYTFTGYYMHWVRQAPGQGLEWMG
WINPNSGGTNYAQKFQGRVTMTRDTSISTAYMELSRLRSDDTAVYYCARDY
GYYGSGSYSSGPLYYYYGMDVWGQGTTVTVSS** [SEQ ID NO: 288]

TSGQAGQHHHHHHGAYPYDVPDYAS [SEQ ID NO: 308]

TABLE 73

ET200-123

DNA Sequence
(light chain variable region scFv linker heavy chain variable region His tag + HA tag)
caggctgtgctgactcagccaccctcagcgtctggaccccccgggcagagggtcaccatctcttgttctggaagcagctccaac
atcggaagtaatactgtaaactggtaccagcagctcccaggaacggcccccaaactcctcatgtataataatgatcagcggccct
cagggggtccctgaccgattctctggctccaagtctggcacctcagcctccctggccatcagtgggctccagtctgaggatgagg
ctgattattactgtgcagcatgggatgacagcctcaatggttatgtcttcggacctgggaccaaggtcaccgtcctaggt [SEQ
ID NO: 289]

<u>tctagaggtggtggtggtagcggcggcggcggctctggtggtggtggatccctcgagatggcc</u> [SEQ ID NO: 305]

**caggtgcagctggtggagtctggagctgaggtgaagaagcctggggcctcagtgaaggtctcctgcaaggcttctggtt
acacctttaccagctatggtatcagctgggtgcgacaggcccctggacaagggcttgagtggatgggatggatcagcgc
ttacaatggtaacacaaactatgcacagaagctccagggcagagtcaccatgaccacagacacatccacgagcacagc
ctacatggagctgaggagcctgagatctgacgacacggccgtgtattactgtgcgagagacctatctcggggagctaac
ccgcattactactactactacggtatggacgtctggggccaagggaccacggtcaccgtctcctca** [SEQ ID NO:
290]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QAVLTQPPSASGTPGQRVTISCSGSSSNIGSNTVNWYQQLPGTAPKLLMYNNDQ
RPSGVPDRFSGSKSGTSASLAISGLQSEDEADYYCAAWDDSLNGYVFGPGTKVT
VLG [SEQ ID NO: 291]

<u>SRGGGGSGGGGSGGGGSLEMA</u> [SEQ ID NO: 307]

**QVQLVESGAEVKKPGASVKVSCKASGYTFTSYGISWVRQAPGQGLEWMGW
ISAYNGNTNYAQKLQGRVTMTTDTSTSTAYMELRSLRSDDTAVYYCARDLS
RGANPHYYYYGMDVWGQGTTVTVSS** [SEQ ID NO: 292]

TSGQAGQHHHHHHGAYPYDVPDYAS [SEQ ID NO: 308]

TABLE 74

ET200-125

DNA Sequence
(light chain variable region scFv linker heavy chain variable region His tag + HA tag)
aattttatgctgactcagccccacgctgtgtcggagtctccggggaagacggtaaccatctcctgcacccgcagcagtggcagt
attgccagcaactatgtgcagtggtaccagcagcgcccggccagttcccccgcactgtgatttatgaggataatcaaagaccct
ctggggtccctggtcggttctctggctccatcgacagctcctccaactctgcctccctcaccatctctggactgaagactgaggac
gaggctgactactactgtcagtcttatgattccaccagtgtgcttttcggcggagggaccaagctgaccgtcctaggt [SEQ
ID NO: 293]

<u>tctagaggtggtggtggtagcggcggcggcggctctggtggtggtggatccctcgagatggcc</u> [SEQ ID NO: 305]

**gaggtccagctggtgcagtctggggctgaggtgaagaagccagggtcctcggtgaaggtctcctgcaaggcctcggga
ggcaccttcagcagcaattctctcagctgggtgcgacaggcccctggacaagggcttgagtggatgggaaggatcttcc
ctatcctgggtataacaaactatgcacagaagttccagggcagagtcacgattaccgcggacaaatccacgagcacag
cctacatggagctgagcagcctgagatctgaggacacggccgtctattactgtgcgagaggaaactaccaatggtatga
tgcttttgatatctggggccaagggacaatggtcaccgtctcttca** [SEQ ID NO: 294]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
NFMLTQPHAVSESPGKTVTISCTRSSGSIASNYVQWYQQRPGSSPRTVIYEDNQR
PSGVPGRFSGSIDSSSNSASLTISGLKTEDEADYYCQSYDSTSVLFGGGTKLTVLG
[SEQ ID NO: 295]

<u>SRGGGGSGGGGSGGGGSLEMA</u> [SEQ ID NO: 307]

**EVQLVQSGAEVKKPGSSVKVSCKASGGTFSSNSLSWVRQAPGQGLEWMGRI
FPILGITNYAQKFQGRVTITADKSTSTAYMELSSLRSEDTAVYYCARGNYQW
YDAFDIWGQGTMVTVSS** [SEQ ID NO: 296]

TSGQAGQHHHHHHGAYPYDVPDYAS [SEQ ID NO: 308]

TABLE 75

ET200-005

DNA Sequence
(light chain variable region scFv linker heavy chain variable region His tag + HA tag)
cagcctgtgctgactcagccaccctcagtgtcagtggtcccaggaaagacggccaggattacctgtgggggaaaaaacattgg
aagtaaaagtgtgcactggtaccagcagaagccaggccaggcccctgtggtggtcatccattatgatagtgaccggccctcag
ggatccctgagcgattctctggctccaactctgggaacacggccaccctgaccatcagcagggtcgaagccggggatgaggc
cgactattactgtcaggtgtgggatagtagtagtgatcatccttatgtcttcggaactgggaccaaggtcaccgtcctaggt
[SEQ ID NO: 297]

<u>tctagaggtggtggtggtagcggcggcggcggctctggtggtggtggatccctcgagatggcc</u> [SEQ ID NO: 305]

**caggtgcagctggtgcagtctggagctgaggtgaagaagcctggggcctcagtgaaggtctcctgcaaggcttctggtt
acacctttaccaactatggtatcagctgggtgcgacaggcccctggacaagggcttgagtggatgggatggatcagcgc
ttacaatggtaacacaaactatgcacataagctccagggcagagtcaccatgaccacagacacatccacgagcacagc
caacatggagctgaggagcctgagacctgacgacactgccgtgtattactgtgcgcgctcttacttcggttctcatgatta
ctggggtcaaggtactctggtgaccgtctcctca** [SEQ ID NO: 298]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
QPVLTQPPSVSVVPGKTARITCGGKNIGSKSVHWYQQKPGQAPVVVIHYDSDRP
SGIPERFSGSNSGNTATLTISRVEAGDEADYYCQVWDSSSDHPYVFGTGTKVTVL
G [SEQ ID NO: 299]

<u>SRGGGGSGGGGSGGGGSLEMA</u> [SEQ ID NO: 307]

**QVQLVQSGAEVKKPGASVKVSCKASGYTFTNYGISWVRQAPGQGLEWMG
WISAYNGNTNYAHKLQGRVTMTTDTSTSTANMELRSLRPDDTAVYYCARSY
FGSHDYWGQGTLVTVSS** [SEQ ID NO: 300]

TSGQAGQHHHHHHGAYPYDVPDYAS [SEQ ID NO: 308]

TABLE 76

ET200-124

DNA Sequence
(light chain variable region scFv linker heavy chain variable region His tag + HA tag)
tcctatgtgctgactcagccaccctcggtgtcagtggccccaggaaagacggccaggattcctgtgggggaaacgacattgga
agtaaaagtgtttttctggtatcagcagaggccaggccaggcccctgtgttggtcgtctatgatgatagcgaccggccctcagggc
tccctgagcgattctctggcttcaactctgggaacacggccaccctgaccatcagcagggtcgaagccggggatgaggccgac
tattactgtcaagtgtgggatagtagtagtgatcattatgtcttcggaactgggaccaaggtcaccgtcctaggt [SEQ ID
NO: 301]

<u>tctagaggtggtggtggtagcggcggcggcggctctggtggtggtggatccctcgagatggcc</u> [SEQ ID NO: 305]

**caggtgcagctggtggagtctggggggaggcttggtacagcctggcaggtccctgagactctcctgtgcagcctctggatt
cacctttgatgattatgccatgcactgggtccggcaagctccagggaagggcctggagtgggtctcaggtattagttgga
atagtggtagcataggctatgcggactctgtgaagggccgattcaccatctccagagacaacgccaagaactccctgtat
ctgcaaatgaacagtctgagagctgaggacacggccttgtattactgtgcaaaagatataaactatggttcggggagtta
tggtgcttttgatatctggggccaagggacaatggtcaccgtctcttca** [SEQ ID NO: 302]

ACTAGTGGCCAGGCCGGCCAGCACCATCACCATCACCATGGCGCATACCCGT
ACGACGTTCCGGACTACGCTTCT [SEQ ID NO: 306]

Amino Acid Sequence
(light chain variable region scFv linker heavy chain variable region His tag + HA tag)
SYVLTQPPSVSVAPGKTARISCGGNDIGSKSVFWYQQRPGQAPVLVVYDDSDRP
SGLPERFSGFNSGNTATLTISRVEAGDEADYYCQVWDSSSDHYVFGTGTKVTVL
G [SEQ ID NO: 303]

<u>SRGGGGSGGGGSGGGGSLEMA</u> [SEQ ID NO: 307]

**QVQLVESGGGLVQPGRSLRLSCAASGFTFDDYAMHWVRQAPGKGLEWVSG
ISWNSGSIGYADSVKGRFTISRDNAKNSLYLQMNSLRAEDTALYYCAKDITY
GSGSYGAFDIWGQGTMVTVSS** [SEQ ID NO: 304]

TSGQAGQHHHHHHGAYPYDVPDYAS [SEQ ID NO: 308]

XI. Exemplary Extracellular Antigen-Binding Domains (e.g., scFvs) Comprising a Heavy Chain Variable Region, a Light Chain Variable Region and a Linker Peptide

TABLE 77

ET200-001

DNA Sequence
Cagtctgtgttgacgcagccaccctcagcgtctgggaccccggggcagagggtcaccatctcttgttctggaagcagctccaac
atcggaagtaatactgtaaactggtaccagcagctcccaggaacggcccccaaactcctcatctatagtaataatcagcggccct
caggggtccctgaccgattctctggctccaagtctggcacctcagcctcctggccatcagtgggctccagtctgaggatgagg
ctgattattactgtgcagcatgggatgacagcctgaatggttatgtcttcggaactgggaccaaggtcaccgtcctaggttctaga
ggtggtggtggtagcggcggcggcggctctggtggtggtggatccctcgagatggcccaggtgcagctacagcagtgggc
gcaggactgttgaagccttcggagaccctgtccctcacctgcgctgtgtatggtgggtccttcagtggttactactggagctggat
ccgccagcccccagggaaggggctggagtggattggggaaatcaatcatagtggaagcaccaactacaacccgtccctcaag
agtcgagtcaccatatcagtagacacgtccaagaaccagttctccctgaagctgagctctgtgaccgccgcggacacggccgt
gtattactgtgcgcgcgaaggtccgtacgacggtttcgattcttggggtcaaggtactctggtgaccgtctcctca [SEQ ID NO: 593]

Amino Acid Sequence
QSVLTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYVFGTGTKVTVL
GSRGGGGSGGGGSGGGGSLEMAQVQLQQWGAGLLKPSETLSLTCAVYGGSFSG
YYWSWIRQPPGKGLEWIGEINHSGSTNYNPSLKSRVTISVDTSKNQFSLKLSSVT
AADTAVYYCAREGPYDGFDSWGQGTLVTVSS [SEQ ID NO: 594]

TABLE 78

ET200-002

DNA Sequence
Aattttatgctgactcagccccactctgtgtcggagtctccggggaagacggtaaccatctcctgcaccgcagcagtggcagc
attgccagcaactatgtgcagtggtaccagcagcgcccgggcagtgcccccaccactgtgatctatgaggataaccaaagacc
ctctggggtccctgatcggttctctggctccatcgacagctcctccaactctgcctccctcaccatctctggactgaagactgagg
acgaggctgactactactgtcagtcttatgatagcagcaattctgtggtattcggcggagggaccaagctgaccgtcctaggttct
agaggtggtggtggtagcggcggcggcggctctggtggtggtggatccctcgagatggcccaggtccagctggtacagtctg
gcactgaggtgaagaagcctgggcctcagtgagggtcgcctgcaaggcttctggttaccccttaacaaatatgacatcaactg
ggtgcgacaggcccctggacaagggcttgagtggatgggaggcatcatccctatctttcgtacaacaaactacgcacagaagtt
ccagggcagagtcacgattaccgcggacgaatccacgagcacagcctacatggagctgagcagcctgagatctgaggacac
ggccgtatattactgtgcgcgcgaatggttctactgggatatctggggtcaaggtactctggtgaccgtctcctca [SEQ ID NO: 595]

Amino Acid Sequence
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSSNSVVFGGGTKLTVLG
SRGGGGSGGGGSGGGGSLEMAQVQLVQSGTEVKKPGASVRVACKASGYPFNK
YDINWVRQAPGQGLEWMGGIIPIFRTTNYAQKFQGRVTITADESTSTAYMELSSL
RSEDTAVYYCAREWFYWDIWGQGTLVTVSS [SEQ ID NO: 596]

TABLE 79

ET200-003

DNA Sequence
Cagtctgtgttgactcagccaccctcagtgtccgtgtccccaggacagacagccagcatctcctgctctggaaataaattgggga
ctaagtatgtttactggtatcagaagaggccaggccagtcccctgtgttggtcatgtatgaagataatcagcggccctcagggatc
ccggagcggttctctggctccaactctgggaacacagccactctgaccatcagagggacccagactgtggatgaggctgactat
tactgtcaggcgtgggactccgacactttcgtggtcttcggcggagggaccaaggtcaccgtcctaggttctagaggtggtggtg
gtagcggcggcggcggctctggtggtggtggatccctcgagatggccgaggtgcagctggtggagaccggggaggcgtg
gtccagcctgggaggtccctgagactctcctgtgcagcctctgggattcaccttcagtagttatggcatgcactgggtccgccagg
ctccaggcaaggggctggagtgggtggcagttatatcacatgatggaagtaataaatactacgcagactccgtgaagggccgat
tcaccatctccagagacaattccaaggacacgctgtatctgcaaatgaacagcctgagaggtgaggacacggccgtatattact
gtgcgcgctctaaccagtggtctggttacttctcttttcgattactggggtcaaggtactctggtgaccgtctcctca [SEQ ID NO: 597]

TABLE 79-continued

ET200-003

Amino Acid Sequence
QSVLTQPPSVSVSPGQTASISCSGNKLGTKYVYWYQKRPGQSPVLVMYEDNQRP
SGIPERFSGSNSGNTATLTIRGTQTVDEADYYCQAWDSDTFVVFGGGTKVTVLG
SRGGGGSGGGGSGGGGSLEMAEVQLVETGGGVVQPGRSLRLSCAASGFTFSSYG
MHWVRQAPGKGLEWVAVISHDGSNKYYADSVKGRFTISRDNSKDTLYLQMNS
LRGEDTAVYYCARSNQWSGYFSFDYWGQGTLVTVSS [SEQ ID NO: 598]

TABLE 80

ET200-006

DNA Sequence
Tcctatgtgctgactcagccaccctcagtgtcagtggccccaggaaagacggccaggattacctgtgggggaaacaacattgg
aagtaaaagtgtgcactggtaccagcagaagccaggccaggcccctgtggtggtcatccattatgatagcgaccggccctcag
ggatccctgagcgattctctggctccaactctgggaacacggccaccatcagcagggtcgaagccggggatgaggc
cgactattactgtcaggtgtgggatagtagtagtgatcatccttatgtcttcggaactgggaccaaggtcaccgtcctaggttctag
aggtggtggtggtagcggcggcggcggctctggtggtggtggatccctcgagatggccgaggtgcagctggtgcagtctgga
gctgaggtgaagaagcctggggcctcagtgaaggtctcctgcaaggcttctggttacacctttaccacctatggtatcagctgggt
gcgacaggcccctggacaagggcttgagtggatgggatggatcaacacttacaatggtcacacaaactatgcacagaagctcc
agggcagagccacaatgaccgcagacacatccacgaacacagccacatggagctgaggagcctgagatctgacgacactg
ccgtgtattactgtgcgcgcgttatctacggttctggtgattactgggtcaaggtactctggtgaccgtctcctca [SEQ ID NO: 599]

Amino Acid Sequence
SYVLTQPPSVSVAPGKTARITCGGNNIGSKSVHWYQQKPGQAPVVVIHYDSDRP
SGIPERFSGSNSGNTATLTISRVEAGDEADYYCQVWDSSSDHPYVFGTGTKVTVL
GSRGGGGSGGGGSGGGGSLEMAEVQLVQSGAEVKKPGASVKVSCKASGYTFTT
YGISWVRQAPGQGLEWMGWINTYNGHTNYAQKLQGRATMTADTSTNTAYMEL
RSLRSDDTAVYYCARVIYGSGDYWGQGTLVTVSS [SEQ ID NO: 600]

TABLE 81

ET200-007

DNA Sequence
Tcctatgtgctgactcagccactctcagtgtcagtggccccaggaaagacggccaggattacctgtgggggaaacaacattgg
aagtaaaactgtgcactggtaccagcagaagccaggccaggcccctgtgctggtcatctattatgatagcgaccggccctcagg
gatccctgagcgattctctggctccaactctgggaacacggccaccctgaccatcagcagggtcgaagccggggatgaggcc
gactattactgtcaggtgtgggatagtagtagtgatcatcgggtgttcggcggagggaccaagctgaccgtcctaggttctagag
gtggtggtggtagcggcggcggcggctctggtggtggtggatccctcgagatggccgaggtgcagctggtggagtctgggg
gaggactggtgaagccttcggagaccctgtccctcacctgcaatgtctctggttactccatcagcagtggttacttttgggctgga
tccggcagccccagggaaggggctggagtggattggagtatctatcatagtaggagcacctactacaacccgtccctcaag
agtcgagtcaccatatcagtagacacgtccaagaaccagttctccctgaagctgaactctgtgaccgccgcagacacggccgtg
tattactgtgcgcgcggttacggttacttcgattactgggtcaaggtactctggtgaccgtctcctca [SEQ ID NO: 601]

Amino Acid Sequence
SYVLTQPLSVSVAPGKTARITCGGNNIGSKTVHWYQQKPGQAPVLVIYYDSDRP
SGIPERFSGSNSGNTATLTISRVEAGDEADYYCQVWDSSSDHRVFGGGTKLTVLG
SRGGGGSGGGGSGGGGSLEMAQVQLQESGPGLVKPSETLSLTCNVSGYSISSGYF
WGWIRQPPGKGLEWIGSIYHSRSTYYNPSLKSRVTISVDTSKNQFSLKLNSVTAA
DTAVYYCARGYGYFDYWGQGTLVTVSS [SEQ ID NO: 602]

TABLE 82

ET200-008

DNA Sequence
Caatctgccctgactcagcctgcctccgtgtctgggtctcctggacagtcgatcaccatctcctgcactggaaccagcagtgacg
ttggtggttataactatgtctcctggtaccaacaacacccaggcaaagcccccaaactcatgatttatgatgtcagtaatcggccct
caggggtttctaatcgcttctctggctccaagtctggcaacacggcctcctgaccatctctgggctccaggctgaggacgaggc
tgattattactgcagctcatatacaagcagcagcacttcgaaggtgttcggcggagggaccaagctgaccgtcctaggttctaga
ggtggtggtggtagcggcggcggcggctctggtggtggtggatccctcgagatggccgaggtgcagctggtggagtctggg
gaggtgtggtacggcctgggggtccctgagactctcctgtgcagcctctggattcacctttggtgattatggcatgagctgggtc
cgccaagctccagggaaggggctggagtgggtctctggtattaattggaatggtggtagcacaggttatgcagactctgtgaag TABLE 82-continued

ET200-008 ggccgattcaccatctccagagacaacgccaagaactccctgtatctgcaaatgaacagtctgagagccgaggacacggccgt
atattactgtgcgcgctctaaatacaacttccatgtttactacgattactggggtcaaggtactctggtgaccgtctcctca [SEQ
ID NO: 603]

Amino Acid Sequence
QSALTQPASVSGSPGQSITISCTGTSSDVGGYNYVSWYQQHPGKAPKLMIYDVSN
RPSGVSNRFSGSKSGNTASLTISGLQAEDEADYYCSSYTSSSTSKVFGGGTKLTVL
GSRGGGGSGGGGSGGGGSLEMAEVQLVESGGGVVRPGGSLRLSCAASGFTFGD
YGMSWVRQAPGKGLEWVSGINWNGGSTGYADSVKGRFTISRDNAKNSLYLQM
NSLRAEDTAVYYCARSKYNFHVYYDYWGQGTLVTVSS [SEQ ID NO: 604]

TABLE 83

ET200-009

DNA Sequence
Cagtctgtgttgacgcagccaccctcagcgtctgggaccccgggcagacagtcaccatctcttgttctggaagcaactccaac
atcggaagtaattatgtatactggtaccagcagctcccaggaacggcccccaaactcctcatctataggaataatcagcggccct
caggggtccctgaccgattctcaggctccaagtctggcacctcagcctcctggccatcagtgggctccgctccgaggatgag
gctgattattactgtgcagcatgggatgacagcctgagtgcttatgtcttcggaactgggaccaaggtcaccgtcctaggttctag
aggtggtggtggtagcggcggcggcggctctggtggtggtggatccctcgagatggcccaggtgcagctggtgcagtctgga
gctgaggtgaagaagcctggggcctcagtgaaggtctcctgcaaggcttctggttacacctttaccagctatggtatcagctggg
tgcgacaggcccctggacaagggcttgagtggatgggatggatcagcgcttacaatggtaacacaaactatgcacagaagctc
cagggcagagtcaccatgaccacagacacatccacgagcacagcctacatggagctgaggagcctgagatctgacgacactg
ccgtgtattactgtgcgcgctcttctggtaacatggtttcttggaaagatatgtggggtcaaggtactctggtgaccgtctcctca
[SEQ ID NO: 605]

Amino Acid Sequence
QSVLTQPPSASGTPGQTVTISCSGSNSNIGSNYVYWYQQLPGTAPKLLIYRNNQR
PSGVPDRFSGSKSGTSASLAISGLRSEDEADYYCAAWDDSLSAYVFGTGTKVTVL
GSRGGGGSGGGGSGGGGSLEMAQVQLVQSGAEVKKPGASVKVSCKASGYTFTS
YGISWVRQAPGQGLEWMGWISAYNGNTNYAQKLQGRVTMTTDTSTSTAYMEL
RSLRSDDTAVYYCARSSGNMVSWKDMWGQGTLVTVSS [SEQ ID NO: 606]

TABLE 84

ET200-010

DNA Sequence
Caatctgccctgactcagcctgcctccgtgtctgggtctcctggacagtcgatcaccatctcctgcactggaaccagcagtgacg
ttggtggttataactctgtctcctggtaccaacaacacccaggcaaagcccccagactcatgatttatgatgtcagtaatcggccct
caggggtttctaatcgcttctctggctccaagtctggcaacacggcctcctgaccatctctgggctccaggctgaggacgaggc
tgattattactgcagctcatatacaagcagcagcacccctttagtcttcggaactgggaccaaggtcaccgtcctaggttctagag
gtggtggtggtagcggcggcggcggctctggtggtggtggatccctcgagatggcccaggtgcagctggtgcagtctggggc
tgaggtgaagaagcctggggcctcagtgaaggtctcctgcaaggcttctggttacacctttaccagctatggtatcagctgggtg
cgacaggcccctggacaagggcttgagtggatgggatggatcagcgcttacaatggtaacacaaactatgcacagaagctcca
gggcagagtcaccatgaccacagacacatccacgagcacagcctacatggagctgaggagcctgagatctgacgacacggc
cgtgtattactgtgcgcgcggtgctgttgcttaccatgattggggtcaaggtactctggtgaccgtctcctca [SEQ ID NO:
607]

Amino Acid Sequence
QSALTQPASVSGSPGQSITISCTGTSSDVGGYNSVSWYQQHPGKAPRLMIYDVSN
RPSGVSNRFSGSKSGNTASLTISGLQAEDEADYYCSSYTSSSTPLVFGTGTKVTVL
GSRGGGGSGGGGSGGGGSLEMAQVQLVQSGAEVKKPGASVKVSCKASGYTFTS
YGISWVRQAPGQGLEWMGWISAYNGNTNYAQKLQGRVTMTTDTSTSTAYMEL
RSLRSDDTAVYYCARGAVAYHDWGQGTLVTVSS [SEQ ID NO: 608]

TABLE 85

ET200-011

DNA Sequence
Cagtctgtcgtgacgcagccgccctcagtgtctgcggccccaggacagagggtcaccatctcctgctctggaagcagctccaa
catttcgatttatgatgtatcctggtatcagcagctcccaggaacagcccccaaactcctcatttatggcaataataagcgaccctc
ggggattgctgaccgattctctggctccacgtctggcacgtcagccaccctgggcatcaccggactccagactgggacgagg

TABLE 85-continued

ET200-011 ccgattattactgcggaacatgggatgacagtctgagtgggggggtgttcggcggagggaccaagctgaccgtcctaggttcta
gaggtggtggtggtagcggcggcggcggctctggtggtggtggatccctcgagatggcccagatgcagctggtgcaatctgg
ggctgaggtgaagaagcctgggtcctcggtgaaggtctcctgcgaggcttctggaggcacccctcagcagctatgctatcaactg
ggtgcgacaggcccctggacaagggcttgagtggatgggagggatcatccctatgtttggtacagcacactacgcacagaagt
tccagggcagagtcacgattaccgcggacgaatccacgaaaacagcctacatggagctgagcagcctgagatctgaggacac
tgccgtgtattactgtgcgcgcggtgttcattacgcttctttcgatcattggggtcaaggtactctggtgaccgtctcctca [SEQ
ID NO: 609]

Amino Acid Sequence
QSVVTQPPSVSAAPGQRVTISCSGSSSNISIYDVSWYQQLPGTAPKLLIYGNNKRP
SGIADRFSGSTSGTSATLGITGLQTGDEADYYCGTWDDSLSGGVFGGGTKLTVLG
SRGGGGSGGGGSGGGGSLEMAQMQLVQSGAEVKKPGSSVKVSCEASGGTLSSY
AINWVRQAPGQGLEWMGGIIPMFGTAHYAQKFQGRVTITADESTKTAYMELSSL
RSEDTAVYYCARGVHYASFDHWGQGTLVTVSS [SEQ ID NO: 610]

TABLE 86

ET200-012

DNA Sequence
Cagtctgtgttgacgcagccgccctcagtgtctgcggccgcaggacagaaggtcaccatctcctgctctggaagcgactccaa
cattgggaataattatgtgtcctggtatcaacacctcccagggacagcccccaaactcctcatttatgacgttaaaaatcgaccctc
agggattcctgaccggttctccggctccaagtctggctcgtcagccaccctaggcatcgccggactccagcctggggacgagg
ccgattattactgcggaacatgggatagcagtcggctggatgcctatgtcttcggaactgggaccaaggtcaccgtcctaggttctag
aggtggtggtggtagcggcggcggcggctctggtggtggtggatccctcgagatggcccagatgcagctggtgcaatctgga
gctgaggtgaagaagcctggggcctcagtgaaggtctcctgcaagacttctggttttccccttaatatctttggaatcacctgggtg
cgacaggcccctggacaagggcttgagtggatgggatggatcagcggttacaacggtaacacagactacccacagaagttcc
agggcagagtcaccatgtccacagacacatccacgagtacagcctacatggagctgaggaacctgaaatctgacgacacggc
cgtgtattactgtgcgcgcggtgcttacggtggtatggatacttggggtcaaggtactctggtgaccgtctcctca [SEQ ID
NO: 611]

Amino Acid Sequence
QSVLTQPPSVSAAAGQKVTISCSGSDSNIGNNYVSWYQHLPGTAPKLLIYDVKNR
PSGIPDRFSGSKSGSSATLGIAGLQPGDEADYYCGTWDSRLDAYVFGTGKVTVL
GSRGGGGSGGGGSGGGGSLEMAQMQLVQSGAEVKKPGASVKVSCKTSGFPFNI
FGITWVRQAPGQGLEWMGWISGYNGNTDYPQKFQGRVTMSTDTSTSTAYMELR
NLKSDDTAVYYCARGAYGGMDTWGQGTLVTVSS [SEQ ID NO: 612]

TABLE 87

ET200-013

DNA Sequence
Cagtctgtcgtgacgcagccgccctcagtgtctggggcccccagggcagagggtcaccatctcctgcactgggagcacctcca
acatcggggcaggttatgatgtacactggtatcagcagcttccaggaacagcccccaaactcctcatctatactaacaactttcgg
ccctcagggggtccctgaccgattctctgcctccaagtctggcacttcagcttccctggccatcactggtctccaggctgaggatga
ggctgattattactgcggaacatgggatagcagcctgagtgccgttgtgttcggcggagggaccaagctgaccgtcctaggttct
agaggtggtggtggtagcggcggcggcggctctggtggtggtggatccctcgagatggccgaggtgcagctggtggagtctg
gaactgaggtgaagaagcctggggcctcagtgaaagtctcctgcaaggcttctggttacatgtttaccagttatggtctcaactgg
gtgcgacaggcccctggacaagggcttgagtggatgggatggatcagcgctaacaatggtaagacaaattatgctaagaaattc
caggacagagtcaccatgaccagagacacttccacgagcacaggctacatggaactgaggagcctgagatctgacgacacg
gccgtatattactgtgcgcgccatatcggtggttcttacttcgatcgttggggtcaaggtactctggtgaccgtctcctca [SEQ
ID NO: 613]

Amino Acid Sequence
QSVVTQPPSVSGAPGQRVTISCTGSTSNIGAGYDVHWYQQLPGTAPKLLIYTNNF
RPSGVPDRFSASKSGTSASLAITGLQAEDEADYYCGTWDSSLSAVVFGGGTKLT
VLGSRGGGGSGGGGSGGGGSLEMAEVQLVESGTEVKKPGASVKVSCKASGYMF
TSYGLNWVRQAPGQGLEWMGWISANNGKTNYAKKFQDRVTMTRDTSTSTGY
MELRSLRSDDTAVYYCARHIGGSYFDRWGQGTLVTVSS [SEQ ID NO: 614]

TABLE 88

ET200-014

DNA Sequence
Tcctatgtgctgactcagccaccctcagtgtcagtggccccaggaaagacggccaggattacctgtgggggaaacaacattgg
aagtaaaagtgtgcactggtaccagcagaagccaggccaggcccctgtgctggtcatctattatgatagcgaccggccctcagg
gatccctgagcgattctctggctccaactctgggaacacggccaccctgaccatcagcagggtcgaagccggggatgaggcc
gactattactgtcaggtgtgggatagtagtagtgatcattatgtcttcggaactgggaccaaggtcaccgtcctaggttctagaggt
ggtggtggtagcggcggcggcggctctggtggtggtggatccctcgagatggccgaggtgcagctggtggagactggggga
ggcttggtacagcctggggggtccctgagactctcctgtgcagcctctggattcacctttagcagctatgccatgagctgggtcc
gccaggctccagggaagggggctggagtgggtctcagctattagtggtagtgatggtagcacatactacgcagactccgtgaag
ggccggttcaccatctccagagacaattccaagaacacgctgtatctgcaaatgaacagcctgagagacgaggacacggccgt
atattactgtgcgcgctctcatgaagctaacctggttggtgattggtgggtcaaggtactctggtgaccgtctcctca [SEQ
ID NO: 615]

Amino Acid Sequence
SYVLTQPPSVSVAPGKTARITCGGNNIGSKSVHWYQQKPGQAPVLVIYYDSDRPS
GIPERFSGSNSGNTATLTISRVEAGDEADYYCQVWDSSSDHYVFGTGTKVTVLGS
RGGGGSGGGGSGGGGSLEMAEVQLVETGGGLVQPGGSLRLSCAASGFTFSSYA
MSWVRQAPGKGLEWVSAISGSDGSTYYADSVKGRFTISRDNSKNTLYLQMNSL
RDEDTAVYYCARSHEANLVGDWWGQGTLVTVSS [SEQ ID NO: 616]

TABLE 89

ET200-015

DNA Sequence
Cagtctgtggtgactcagccaccctcagtgtcagtggccccaggaaagacggccaggattacctgtgggggaaacaacattg
gaagtaaaagtgtgcactggtaccagcagaagccaggccaggcccctgtgctggtcatctattatgatagcgaccggccctcag
ggatccctgagcgattctctggctccaactctgggaacacggccaccctgaccatcagcagggtcgaagccggggatgaggc
cgactattactgtcaggtgtgggatagtagtagtgatgtggtattcggcggagggaccaagctgaccgtcctaggttctagaggt
ggtggtggtagcggcggcggcggctctggtggtggtggatccctcgagatggccgaggtccagctggtacagtctggagctg
aggtgaagaagcctggggcctcagtgaaggtctcctgcaaggcttctggttacacctttaccagctacggtatcagctgggtgcg
acaggcccctggacaagggcttgagtggatgggatggatcagcgcttacaatggtaacacaaactatgcacagaagctccagg
gcagagtcaccatgaccacagacacatccacgagcacagcctacatggagctgaggagcctgagatctgacgacacggccgt
gtattactgtgcgcgctggggtggtttcggtgctgttgatcattggggtcaaggtactctggtgaccgtctcctca [SEQ ID
NO: 617]

Amino Acid Sequence
QSVVTQPPSVSVAPGKTARITCGGNNIGSKSVHWYQQKPGQAPVLVIYYDSDRP
SGIPERFSGSNSGNTATLTISRVEAGDEADYYCQVWDSSSDVVFGGGTKLTVLGS
RGGGGSGGGGSGGGGSLEMAEVQLVQSGAEVKKPGASVKVSCKASGYTFTSYG
ISWVRQAPGQGLEWMGWISAYNGNTNYAQKLQGRVTMTTDTSTSTAYMELRS
LRSDDTAVYYCARWGGFGAVDHWGQGTLVTVSS [SEQ ID NO: 618]

TABLE 90

ET200-016

DNA Sequence
Tcttctgagctgactcaggaccctgctgtgtctgtggccttgggacagacagtcaagatcacgtgccaaggagacagcctcaca
gactaccatgcaacctggtaccagcagaagccaggacaggcccctgtcgctgtcatctatgctacaaacaaccgggccactgg
gatcccagaccgattctctggttccagttccggaaacacagcttcttgaccatcactggggctcaggcggaagatgaggctgac
tattactgtaattcccgggacagcggcacggacgaagtgttattcggcggagggaccaagctgaccgtcctaggttctagaggt
ggtggtggtagcggcggcggcggctctggtggtggtggatccctcgagatggccgaggtgcagctggtggagactggggga
ggcctggtcaagcctggggggtccctgagactctcctgtgcagcctctggattcacctttcagtagctatagcatgaactgggtcc
gccaggctccagggaaggggctggagtgggtctcatccattagtagtagtagttactatactacgcagactcagtgaagg
gccgattcaccatctccagagacaacgccaagaactcactgtatctgcaaatgaacagcctgagagccgaggacacggccgtg
tattactgtgcgcgcggtcagggttacgattactggggtcaaggtactctggtgaccgtctcctca [SEQ ID NO: 619]

Amino Acid Sequence
SSELTQDPAVSVALGQTVKITCQGDSLTDYHATWYQQKPGQAPVAVIYATNNRP
TGIPDRFSGSSSGNTASLTITGAQAEDEADYYCNSRDSGTDEVLFGGGTKLTVLG
SRGGGGSGGGGSGGGGSLEMAEVQLVETGGGLVKPGGSLRLSCAASGFTFSSYS
MNWVRQAPGKGLEWVSSISSSSYIYYADSVKGRFTISRDNAKNSLYLQMNSLR
AEDTAVYYCARGQGYDYWGQGTLVTVSS [SEQ ID NO: 620]

TABLE 91

ET200-017

DNA Sequence
Tcctatgtgctgactcagccaccctcggtgtcagtggccccaggaaagacggccaggattacctgtgggggaaacaacattgg
aagtaaaagtgtgcactggtaccagcagaagccaggccaggcccctgtgctggtcgtctatgatgatagcgaccggccctcag
ggatccctgagcgattctctggctccaactctgggaacacggccaccctgagcatcagcagggtcgaagccggggatgaggc
cgactattactgtcaggtgtgggatagtagtagtgatcatactgtcttcggaactgggaccaaggtcaccgtcctaggttctagag
gtggtggtggtagcggcggcggcggctctggtggtggtggatccctcgagatggcccaggtgcagctacagcagtggggcg
caggactgttgaagccttcggagaccctgtccctcacctgcgctgtctatggtgggtccttcagtggttactactggagctggatc
cgccagcccccagggaaggggctggagtggattgggaaatcaatcatagtggaagcaccaactacaacccgtccctcaaga
gtcgagtcaccatatcagtagacacgtccaagaaccagttctccctgaagctgagctctgtgaccgccgcggacacggccgtgt
attactgtgcgcgctactaccgggtatggatatgtggggtcaaggtactctggtgaccgtctcctca [SEQ ID NO: 621]

Amino Acid Sequence
SYVLTQPPSVSVAPGKTARITCGGNNIGSKSVHWYQQKPGQAPVLVVYDDSDRP
SGIPERFSGSNSGNTATLSISRVEAGDEADYYCQVWDSSSDHTVFGTGTKVTVLG
SRGGGGSGGGGSGGGGSLEMAQVQLQQWGAGLLKPSETLSLTCAVYGGSFSGY
YWSWIRQPPGKGLEWIGEINHSGSTNYNPSLKSRVTISVDTSKNQFSLKLSSVTA
ADTAVYYCARYYPGMDMWGQGTLVTVSS [SEQ ID NO: 622]

TABLE 92

ET200-018

DNA Sequence
Caggctgtgctgactcagccgccctcaacgtctgggaccccgggcagagggtcaccatctcttgttctggaagcagctccaa
catcgggagaaatggtgtaaactggtaccagcagctcccaggagcggcccccaaagtcctcatctataatgataatcagcgacc
ctcaggggtccctgaccgagtctctggctccagtctggctcctcaggcaccctggccatcgatgggcttcggtctgaggatga
ggctgattattactgtgcggcatgggatgacagcctgcatggtgtggtattcggcggagggaccaagctgaccgtcctaggttct
agaggtggtggtagcggcggcggcggctctggtggtggatccctcgagatggcccaggtccagctggtacagtctg
gggctgaggtgaagaagcctggggcctcagtgaaggtctcctgcaaggtttccggatacaccctcaatgaattatccatgcactg
ggtgcgacaggctcctggaaaagggcttgagtggatgggaggttttgatcctgaagatggtgaaacaatctacgcacagaagtt
ccagggcagagtcaccatgaccgaggacacatctacagacacagcctacatggagctgagcagcctgagatctgaggacact
gccgtgtattactgtgcgcgcggtggttacggtgattcttggggtcaaggtactctggtgaccgtctcctca [SEQ ID NO:
623]

Amino Acid Sequence
QAVLTQPPSTSGTPGQRVTISCSGSSSNIGRNGVNWYQQLPGAAPKVLIYNDNQR
PSGVPDRVSGSQSGSSGTLAIDGLRSEDEADYYCAAWDDSLHGVVFGGGTKLTV
LGSRGGGGSGGGGSGGGGSLEMAQVQLVQSGAEVKKPGASVKVSCKVSGYTL
NELSMHWVRQAPGKGLEWMGGFDPEDGETIYAQKFQGRVTMTEDTSTDTAYM
ELSSLRSEDTAVYYCARGGYGDSWGQGTLVTVSS [SEQ ID NO: 624]

TABLE 93

ET200-019

DNA Sequence
Aattttatgctgactcagccccactctgtgtcggagtctccggggaagacggtaaccatctcctgcacccgcagcagtggcagc
attgccagcaactatgtgcagtggtaccagcagcgcccgggcagtgcccccaccactgtgatctatgaggataaccaaagacc
ctctggggtccctgatcggttctctggctccatcgacagctcctccaactctgcctccctcaccatctctggactgaagactgagg
acgaggctgactactgtcagtcttatgatagcagcaattcttgggtgttcggcggagggaccaagctgaccgtcctaggttct
agaggtggtggtagcggcggcggcggctctggtggtggtggatccctcgagatggcccaggtgcagctggtgcaatctg
gggctgaggtgaagaggcctgggtcctcggtgaaggtctcctgcacggcttctgaggcaccttcagcagcgatgctatcagct
gggtgcgacaggcccctggacaagggcttgagtggatgggaggaatcatccctatgtttggtacagcaaactacgcacagaag
ttccagggcagagtcacgattaccgcggacgaatccacgagcacagcctacatggagctgagcagcctgagatctgaggaca
cggccgtgtattactgtgcgcgcgaaggttactactaccgtctgcttacctgggttctgttctgaacgacatctcttctgtttacgat
gaatgggtcaaggtactctggtgaccgtctcctca [SEQ ID NO: 625]

Amino Acid Sequence
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSSNSWVFGGGTKLTVL
GSRGGGGSGGGGSGGGGSLEMAQVQLVQSGAEVKRPGSSVKVSCTASGGTFSS
DAISWVRQAPGQGLEWMGGIIPMFGTANYAQKFQGRVTITADESTSTAYMELSS
LRSEDTAVYYCAREGYYYPSAYLGSVLNDISSVYDEWGQGTLVTVSS [SEQ ID
NO: 626]

TABLE 94

ET200-020

DNA Sequence
Cagtctgtcgtgacgcagccgccctcagtgtctgcggccccaggacagaaggtcaccatctcctgctctggaagcacctccaa
cattggaaataatgatgtatcctggtaccagcagctcccaggaacagcccccaaactcctcatttatgacaataataagcgaccct
cagggattcctgaccgattctctggctccaagtctggcacgtcagccaccctgggcatcaccggactccagactggggacgag
gccgattattactgcgcaacatggatagcagcgtgagtgcttcttgggtcttcggcagagggaccaagctgaccgtcctaggtt
ctagaggtggtggtggtagcggcggcggcggctctggtggtggtggatccctcgagatggcccaggtgcagctggtgcagtct
ggagctgaggtgaagaagcctggggcctcagtgaaggtctcctgcaaggcttctggttacacctttaccagctatggtatcagct
gggtgcgacaggcccctggacaagggcttgagtggatgggatggatcagcgcttacaatggtaacacaaactatccacagaa
gctccagggcagagtcaccatgaccacagacccatccacgagcacagcctacatggagctgaggagcctgagatctgacgac
acggccgtgtattactgtgcgcgctctatgacttctttcgattactggggtcaaggtactctggtgaccgtctcctca [SEQ ID
NO: 627]

Amino Acid Sequence
QSVVTQPPSVSAAPGQKVTISCSGSTSNIGNNDVSWYQQLPGTAPKLLIYDNNKR
PSGIPDRFSGSKSGTSATLGITGLQTGDEADYYCGTWDSSVSASWVFGRGTKLTV
LGSRGGGGSGGGGSGGGGSLEMAQVQLVQSGAEVKKPGASVKVSCKASGYTFT
SYGISWVRQAPGQGLEWMGWISAYNGNTNYPQKLQGRVTMTTDPSTSTAYMEL
RSLRSDDTAVYYCARSMTSFDYWGQGTLVTVSS [SEQ ID NO: 628]

TABLE 95

ET200-021

DNA Sequence
Cagtctgtgttgacgcagccgccctcagtgtctgcggccccaggacagaaggtcaccatctcctgctctggaagcaactccaa
cattgggaataattatgtatcctggtatcagcaactcccagggacagcagcccccaaactcctcatttatgacaataataagcgaccctc
agggattcctgaccgattctctggctccaggtctggcacgtcagccaccctgggcatcaccggactccagactggggacgagg
ccgattattactgcggaacatggaataccactgtgactcctggctatgtcttcggaactgggaccaaggtcaccgtcctaggttcta
gaggtggtggtggtagcggcggcggcggctctggtggtggtggatccctcgagatggccgaagtgcagctggtgcagtctgg
agctgaggtgaagaagcctggggcctcagtgaaggtctcctgcaaggcttctggttacacctttaccagctatggtatcagctgg
gtgcgacaggcccctggacaagggcttgagtggatgggatggatcagcgcttacaatggtaacacaaactatgcacagaagct
ccagggcagagtcaccatgaccacagacacatccacgagcacagcctacatggagctgaggagcctgagatctgacgacac
cgccatgtattactgtgcgcgctctgtttacgacctggatacttggggtcaaggtactctggtgaccgtctcctca [SEQ ID
NO: 629]

Amino Acid Sequence
QSVLTQPPSVSAAPGQKVTISCSGSGSNSNIGNNYVSWYQQLPGTAPKLLIYDNNKR
PSGIPDRFSGSRSGTSATLGITGLQTGDEADYYCGTWNTTVTPGYVFGTGTKVTV
LGSRGGGGSGGGGSGGGGSLEMAEVQLVQSGAEVKKPGASVKVSCKASGYTFT
SYGISWVRQAPGQGLEWMGWISAYNGNTNYAQKLQGRVTMTTDTSTSTAYME
LRSLRSDDTAMYYCARSVYDLDTWGQGTLVTVSS [SEQ ID NO: 630]

TABLE 96

ET200-022

DNA Sequence
cagtctgtcgtgacgcagccgccctcagtgtctgcggccccaggacagaaggtcaccatctcctgctctggaagcagctccaa
cattgggaataattatgtatcctggtaccagcagctcccaggaacagcccccaaactcctcatttatgacaataataagcgaccct
cagggattcctgaccgattctctggctccaagtctggcacgtcagccaccctgggcatcaccggactccagactggggacgag
gccgattattactgcgcaacatggatagcagcctgggggccccttatgtcttcggaactgggaccaaggtcaccgtcctaggtt
ctagaggtggtggtggtagcggcggcggcggctctggtggtggtggatccctcgagatggccgaggtgcagctggtgcagtc
ttgggggaggctcggaacagcctggcaggtccctgagactctcctgtgcagcctctggattcacctttgatgattatgccatgcact
gggtccggcaagctccagggaagggcctggagtgggtctcaggtattagttggaatagcggtagcataggctatgcggactct
gtgaagggccgattcaccatctccagagacaacgccaagaattccctgtatctgcaaatgaacagtctgagagctgaggacacc
gccatgtattactgtgcgcgctaccgtcaggttggttctgcttacgattcttggggtcaaggtactctggtgaccgtctcctca
[SEQ ID NO: 631]

Amino Acid Sequence
QSVVTQPPSVSAAPGQKVTISCSGSSSNIGNNYVSWYQQLPGTAPKLLIYDNNKR
PSGIPDRFSGSKSGTSATLGITGLQTGDEADYYCGTWDSSLGAPYVFGTGTKVTV
LGSRGGGGSGGGGSGGGGSLEMAEVQLVQSWGGSEQPGRSLRLSCAASGFTFD
DYAMHWVRQAPGKGLEWVSGISWNSGSIGYADSVKGRFTISRDNAKNSLYLQM
NSLRAEDTAMYYCARYRQVGSAYDSWGQGTLVTVSS [SEQ ID NO: 632]

TABLE 97

ET200-023

DNA Sequence
ctgcctgtgctgactcagccaccctcggtgtcagtggccccaggaaagacggccaggattacctgtgggggaaacaacattgg
aagtaaaagtgtgcactggtatcagcagaagccaggccaggcccctgtgctggtcgtctatgctgatagcgaccggccctcag
ggatccctgagcgattctctggctccaactctgggaacacggccaccctgaccatcagcagggtcgaagccggggatgaggc
cgactattactgtcaggtgtgggatagtagtagttatcataattatgtcttcggaactgggaccaaggtcaccgtcctaggttctaga
ggtggtggtggtagcggcggcggcggctctggtggtggtggatccctcgagatggccgaggtgcagctggtgcagtctggag
ctgaggtgaagaagcctggggcctcagtgaaggtctcctgcaaggcttctggttacacctttaccagctatggtatcagctgggt
gcgacaggcccctggacaagggcttgagtggatgggatggatcagcgcttacaatggtaacacaaactatgcacagaagctcc
agggcagagtcaccatgaccacagacacatccacgagcacagcctacatggagctgagcagcctgagatctgaggacaccg
ccatgtattactgtgcgcgctactgggggtttcggtgtttctgatcgttggggtcaaggtactctggtgaccgtctcctca [SEQ
ID NO: 633]

Amino Acid Sequence
LPVLTQPPSVSVAPGKTARITCGGNNIGSKSVHWYQQKPGQAPVLVVYADSDRP
SGIPERFSGSNSGNTATLTISRVEAGDEADYYCQVWDSSSYHNYVFGTGTKVTVL
GSRGGGGSGGGGSGGGGSLEMAEVQLVQSGAEVKKPGASVKVSCKASGYTFTS
YGISWVRQAPGQGLEWMGWISAYNGNTNYAQKLQGRVTMTTDTSTSTAYMEL
SSLRSEDTAMYYCARYWGFGVSDRWGQGTLVTVSS [SEQ ID NO: 634]

TABLE 98

ET200-024

DNA Sequence
aattttatgctgactcagcccccactctgtgtcggagtctccggggaagacggtaaccatctcctgcaccggcagcagtggcagc
attgccagcaactatgtgcagtggtaccagcagcgcccgggcagtgcccccaccactgtgatctatgaggataaccaaagacc
ctctggggtccccgatcggttctctggctccatcgacagctcctccaactctgcctcctcaccatctctggactgaagactgagg
acgaggctgactactactgtcagtcttatgacagcagcaatctttgggtgttcggcggagggaccaagctgaccgtcctaggttct
agaggtggtggtggtagcggcggcggcggctctggtggtggtggatccctcgagatggcccagatgcagctggtgcagtctg
gggctgaggtgaagaagcctgggtcctcggtgaaggtctcctgcaaggcttctggaggcaccttcagcagctatgctatcagct
gggtgcgacaggcccctggacaagggcttgagtggatgggagggatcatccctatctttggtacagcaaactacgcacagaag
ttccagggcagagtcacgattaccgcggacgaatccacgagcacagcctacatggagctgagcagcctgagatctgaggaca
ctgccgtgtattactgtgcgcgctacaactactactactacgattcttggggtcaaggtactctggtgaccgtctcctca [SEQ
ID NO: 635]

Amino Acid Sequence
NFMLTQPHSVSESPGKTVTISCTGSSGSIASNYVQWYQQRPGSAPTTVIYEDNQR
PSGVPDRFSGSIDSSSNSASLTISGLKTEDEADYYCQSYDSSNLWVFGGGTKLTVL
GSRGGGGSGGGGSGGGGSLEMAQMQLVQSGAEVKKPGSSVKVSCKASGGTFSS
YAISWVRQAPGQGLEWMGGIIPIFGTANYAQKFQGRVTITADESTSTAYMELSSL
RSEDTAVYYCARYNYYYYDSWGQGTLVTVSS [SEQ ID NO: 636]

TABLE 99

ET200-025

DNA Sequence
gacatccagatgacccagtctccatcctccctgtctgcatctgtaggagacagagtcaccatcacttgccgggcaagtcagagca
ttagcagctatttaaattggtatcagcagaaaccagggaaagcccctaagctcctgatctatgctgcatccagtttgcaaagtggg
gtcccatcaaggttcagtggcagtggatctgggacagatttcactctcaccatcagcagtctgcaacctgaagattttgcaacttac
tactgtcaacagagttacagtaccccattcacttttcggccctgggaccaaagtggatatcaaacgttctagaggtggtggtggtag
cggcggcggcggctctggtggtggtggatccctcgagatggccgaggtgcagctggtgcagtctggggctgaggtgaagaa
gcctgggtcctcggtgaaggtctcctgcaaggcttctggaggcacctttagcagctatggtgcgacaggcccc
tggacaagggcttgagtggatgggagggatcatccctatctttggtacagcaaactacgcacagaagttccagggcagagtcac
gattaccgcggacgaatccacgagcacagcctacatggagctgagcagcctgagatctgaggacaccgccatgtattactgtg
cgcgctactggggttacgactcttacgatgaatggggtcaaggtactctggtgaccgtctcctca [SEQ ID NO: 637]

Amino Acid Sequence
DIQMTQSPSSLSASVGDRVTITCRASQSISSYLNWYQQKPGKAPKLLIYAASSLQS
GVPSRFSGSGSGTDFTLTISSLQPEDFATYYCQQSYSTPFTFGPGTKVDIKRSRGG
GGSGGGGSGGGGSLEMAEVQLVQSGAEVKKPGSSVKVSCKASGGTFSSYAISW
VRQAPGQGLEWMGGIIPIFGTANYAQKFQGRVTITADESTSTAYMELSSLRSEDT
AMYYCARYWGYDSYDEWGQGTLVTVSS [SEQ ID NO: 638]

TABLE 100

| ET200-026 |
| --- |

DNA Sequence
aattttatgctgactcagccccactctgtgtcggagtctccggggaagacggtaaccatctcctgcaccggcagcagtggcagc
attgccagcaactatgtgcagtggtaccagcagcgcccgggcagtgcccccaccactgtgatctatgaggataaccaaagacc
ctctggggtccctgatcggttctctggctccatcgacagctcctccaactctgcctcctcaccatctctggactgaagactgagg
acgaggctgactactactgtcagtcttatgatagcagcaattgggtgttcggcggagggaccaagctgaccgtcctaggttctag
aggtggtggtggtagcggcggcggcggctctggtggtggtggatccctcgagatggccgaggtccagctggtgcagtctggg
gctgaggtgaagaagcctgggtcctcggtgaaggtctcctgcaaggcttctggaggcaccttcagcagctatgctatcagctgg
gtgcgacaggcccctggacaagggcttgagtggatgggagggatcatccctatctttggtacagcaaactacgcacagaagttc
cagggcagagtcacgattaccgcggacgaatccacgagcacagcctacatggagctgagcagcctgagatctgaggacacg
gccgtgtattactgtgcgcgcaacaaccattactacaacgattactggggtcaaggtactctggtgaccgtctcctca [SEQ
ID NO: 639]

Amino Acid Sequence
NFMLTQPHSVSESPGKTVTISCTGSSGSIASNYVQWYQQRPGSAPTTVIYEDNQR
PSGVPDRFSGSIDSSSNSASLTISGLKTEDEADYYCQSYDSSNWVFGGGTKLTVL
GSRGGGGSGGGGSGGGGSLEMAEVQLVQSGAEVKKPGSSVKVSCKASGGTFSS
YAISWVRQAPGQGLEWMGGIIPIFGTANYAQKFQGRVTITADESTSTAYMELSSL
RSEDTAVYYCARNNHYYNDYWGQGTLVTVSS [SEQ ID NO: 640]

TABLE 101

| ET200-027 |
| --- |

DNA Sequence
cagtctgtgttgacgcagccgccctcagtgtctggggccccagggcaggggtcaccatccctgcactgggagcagctcca
acatcggggcaggttatgatgtacactggtaccagcagcttccaggaacagcccccaaactcctcatctatggtaacaacaatcg
gccctcaggggtccctgaccgcttctctggctccaggtctggctgatgtggtattcggcggagggaccaaggtcaccgtcctaggtt
ctagaggtggtggtggtagcggcggcggcggctctggtggtggtggatccctcgagatggccgaggtccagctggtgcagtct
ggggctgaggtgaagaagcctggggctacagtgaaaatctcctgcaaggtttctggatacaccttcaccgactactacatgcact
gggtgcaacaggcccctggaaaagggcttgagtggatgggacttgttgatcctgaagatggtgaaacaatatacgcagagaag
ttccagggcagagtcaccataaccgcggacacgtctacagacacagcctacatggagctgagcagcctgagatctgaggaca
cggccgtgtattactgtgcgcgctactggtcttactctttcgactacctgtacatgccggaaggtaacgattggtggggtcaaggta
ctctggtgaccgtctcctca [SEQ ID NO: 641]

Amino Acid Sequence
QSVLTQPPSVSGAPGQGVTIPCTGSSSNIGAGYDVHWYQQLPGTAPKLLIYGNNN
RPSGVPDRFSGSRSGSSASLAITGLQAEDEADYYCQSYDSSLSDVVFGGGTKVTV
LGSRGGGGSGGGGSGGGGSLEMAEVQLVQSGAEVKKPGATVKISCKVSGYTFT
DYYMHWVQQAPGKGLEWMGLVDPEDGETIYAEKFQGRVTITADTSTDTAYME
LSSLRSEDTAVYYCARYWSYSFDYLYMPEGNDWWGQGTLVTVSS [SEQ ID NO:
642]

TABLE 102

| ET200-028 |
| --- |

DNA Sequence
cagtctgtgttgactcagccacccgcagcgtctgggaccccgggacagagagtcaccatctcttgttctgggggcgtctccaac
atcgggagtggtgctctaaattggtaccagcaactcccaggaacggcccccaaactcctcatctatagttacaatcagcggccct
caggggtctctgaccgattctctggctccaggtctgccacctcagcctccctggccatgggctccagtctgaggatgaggc
tgattattactgtgcaacctgggatgatagtgtgaatggttgggtgttcggcggagggaccaagctgaccgtcctaggttctagag
gtggtggtggtagcggcggcggcggctctggtggtggtggatccctcgagatggccaggtccagctggtacagtctggagct
gaggtgaagaagcctggggattcagtgaaggtctcctgcaagccttctggttacaattttctcaactatggtatcaactgggtgcg
acaggcccctggacaagggcttgagtggatgggatggattagcacttacaccggtaacaaactatgcacagaagctgcagg
gcagagtcaccttcaccacagacacatccacgagcacagcctacatggagatgaggagcctgagatctgacgacacggccgt
gtattactgtgcgcgcgacctgtactactacgaaggtgttgattactggggtcaaggtactctggtgaccgtctcctca [SEQ
ID NO: 643]

Amino Acid Sequence
QSVLTQPPAASGTPGQRVTISCSGGVSNIGSGALNWYQQLPGTAPKLLIYSYNQR
PSGVSDRFSGSRSATSASLAISGLQSEDEADYYCATWDDSVNGWVFGGGTKLTV
LGSRGGGGSGGGGSGGGGSLEMAQVQLVQSGAEVKKPGDSVKVSCKPSGYNFL
NYGINWVRQAPGQGLEWMGWISTYTGNTNYAQKLQGRVTFTTDTSTSTAYME
MRSLRSDDTAVYYCARDLYYYEGVDYWGQGTLVTVSS [SEQ ID NO: 644]

TABLE 103

ET200-029

DNA Sequence
caggctgtgctgactcagccaccctcagtgtcagtggccccaggaaagacggccagggttacctgtgggggaaacaacattg
gaagtgaaagtgtgcactggtaccagcagaagccaggccaggcccctgtgttggtcatctattatgataccgaccggccctcag
ggatccctgagcgattctctggctcccactctgggaccacggccaccctgaccatcagcagggtcgaagccggggatgaggc
cgactattactgtcaggtgtgggatagtagtagggatcatgtggtattcggcggagggaccaagctgaccgtcctaggttctaga
ggtggtggtggtagcggcggcggcggctctggtggtggtggatccctcgagatggcccaggtgcagctggtgcagtctgggg
gaggcgtggtccagcctggaggtccctgagactctcctgtgcggcctctggattccacttcagtagctatgctatgcactgggt
ccgccaggctccaggcaagggactggagtgggtggcagttatatcatatgatggaagcaataaatactacgcagactccgtga
agggccgattcaccatctccagagacaattccaagaacacgctgtatctgcaaatgaacagcctgagagctgaggacacggcc
gtgtattactgtgcgcgctcttacttcacttctggtttctacgattactgggtcaaggtactctggtgaccgtctcctca [SEQ ID
NO: 645]

Amino Acid Sequence
QAVLTQPPSVSVAPGKTARVTCGGNNIGSESVHWYQQKPGQAPVLVIYYDTDRP
SGIPERFSGSHSGTTATLTISRVEAGDEADYYCQVWDSSRDHVVFGGGTKLTVLG
SRGGGGSGGGGSGGGGSLEMAVQLVQSGGGVVQPGRSLRLSCAASGFTFSSY
AMHWVRQAPGKGLEWVAVISYDGSNKYYADSVKGLFTISRDNSKNTLYLQMN
SLRAEDTAVYYCARSYFTSGFYDYWGQGTLVTVSS [SEQ ID NO: 646]

TABLE 104

ET200-030

DNA Sequence
cagtctgtcgtgacgcagccgccctcagtgtctggggccccagggcagagggtcaccatctcctgcactgggagcagttccaa
catcggggcaggttatgatgtaaattggtatcagcagtttccaggaacagcccccaaactcctcatctatggtaacagcaatcggc
cctcaggggtccctgaccgattctctggctccaagtctggcacctcagcctccctggccatcactgggctccaggctgaggatg
aggctgattattactgccagtcctatgacagcagcctgagtggctcttatgtcttcggaactgggaccaaggtcaccgtcctaggtt
ctagaggtggtggtggtagcggcggcggcggctctggtggtggtggatccctcgagatggcccagatgcagctggtgcagtct
ggggctgaggtgaagaagcctcagtgaaggtctccggatacaccctcactgaattatccatgcac
tgggtgcgacaggctcctggaaaagggcttgagtggatggggaggttttgatcctgaagatggtgaaacaatctacgcacagaag
ttccagggcagagtcaccatgaccgaggacacatctacagacacagcctacatggagctgagcagcctgagatctgaggaca
ctgccgtgtattactgtgcgcgcatgtcttctatgtactacgattggggtcaaggtactctggtgaccgtctcctca [SEQ ID
NO: 647]

Amino Acid Sequence
QSVVTQPPSVSGAPGQRVTISCTGSSSNIGAGYDVNWYQQFPGTAPKLLIYGNSN
RPSGVPDRFSGSKSGTSASLAITGLQAEDEADYYCQSYDSSLSGSYVFGTGTKVT
VLGSRGGGGSGGGGSGGGGSLEMAQMQLVQSGAEVKKPGASVKVSCKASGYT
LTELSMHWVRQAPGKGLEWMGGFDPEDGETIYAQKFQGRVTMTEDTSTDTAY
MELSSLRSEDTAVYYCARMSSMYYDWGQGTLVTVSS [SEQ ID NO: 648]

TABLE 105

ET200-031

DNA Sequence
tcctatgtgctgactcagccaccctcagtgtcagtggccccaggaaagacggccaggattacctgtgggggaaacaacattgga
agtaaaagtgtgcactggtaccagcagaagccaggccaggcccctgtgctggtcatctattatgatagcgaccggccctcagg
gatccctgagcgattctctggctccaactctgggaacacggccaccctgaccatcagcagggtcgaagccggggatgaggcc
gactattactgtcaggtgtgggatagtagtagtgattatgtcttcggaactgggaccaaggtcaccgtcctaggttctagaggtggt
ggtggtagcggcggcggcggctctggtggtggtggatccctcgagatggccgaggtgcagctggtggagactggggaggc
ttggtcaagcctggagggtccctgagactctcctgtgcagcctctggattcaccgtcagtgactactacatgagctgggtccgcca
ggctccagggaagggcctggagtggatttcatacattagtggtagtggtaatagcatatactacgcagactctgtgaagggccga
ttcaccatctccagggacaacgccaagaactcactggatctgcaaatgaccagcctgagagccgaggacacggccgtatatta
ctgtgcgcgctctactaaattcgattactgggtcaaggtactctggtgaccgtctcctca [SEQ ID NO: 649]

Amino Acid Sequence
SYVLTQPPSVSVAPGKTARITCGGNNIGSKSVHWYQQKPGQAPVLVIYYDSDRPS
GIPERFSGSNSGNTATLTISRVEAGDEADYYCQVWDSSDYVFGTGTKVTVLGSR
GGGGSGGGGSGGGGSLEMAEVQLVETGGGLVKPGGSLRLSCAASGFTVSDYM
SWIRQAPGKGLEWISYISGSGNSIYYADSVKGRFTISRDNAKNSLDLQMTSLRAE
DTAVYYCARSTKFDYWGQGTLVTVSS [SEQ ID NO: 650]

TABLE 106

ET200-032

DNA Sequence
ctgcctgtgctgactcagccaccctcagcgtctgggaccccgggcagagggtcaccatctcttgttctggaagcagctccaac
gtcggaagttacactgtaaactggtaccggcaactcccaggaacggcccccacactcctcatctataataataatcagcggccct
caggggtccctgaccgattctctgactccaagtctggcacctcggcctcctgaccattagtgggctccagcctgaggatgagg
ctgattattattgtgcagcatgggatgacaggctgggtggttatgtcttcggaactgggaccaaggtcaccgtcctaggttctaga
ggtggtggtggtagcggcggcggcggctctggtggtggtggatccctcgagatggccgaggtgcagctggtgcagtctggag
cagaggtgaaaaagccgggggagtctctgaagatctcctgtaaggggtctggatacagctttaccaactactggatcggctgggt
gcgccagatgcccgggaaaggcctggagtggatggggatcatctatcctggtgactctgataccagatacagcccgtccttcca
aggccaggtcaccatctcagccgacaagtccatcagcaccgcctacctacagtggagcagcctgaaggcctcggacaccgcc
atgtattactgtgcgcgctctactggttcttctcatatgtctgatgaatggggtcaaggtactctggtgaccgtctcctca [SEQ
ID NO: 651]

Amino Acid Sequence
LPVLTQPPSASGTPGQRVTISCSGSSSNVGSYTVNWYRQLPGTAPTLLIYNNNQRP
SGVPDRFSDSKSGTSASLTISGLQPEDEADYYCAAWDDRLGGYVFGTGTKVTVL
GSRGGGGSGGGGSGGGGSLEMAEVQLVQSGAEVKKPGESLKISCKGSGYSFTNY
WIGWVRQMPGKGLEWMGIIYPGDSDTRYSPSFQGQVTISADKSISTAYLQWSSL
KASDTAMYYCARSTGSSHMSDEWGQGTLVTVSS [SEQ ID NO: 652]

TABLE 107

ET200-033

DNA Sequence
aatttatgctgactcagccccactctgtgtcggagtctccggggaagacggtaaccatctcctgcaccggcagcagtggcagc
attgccagcaactatgtgcagtggtaccagcagcgcccgggcagtgcccccaccactgtgatctatgaggataaccaaagacc
ctctggggtccctgatcggttctccatcgacagctcctccaactctgcctccctccaccatctctggactgaagactgagg
acgaggctgactactactgtcagtcttatgatagcagcaatcattgggtgttcggcggagggaccaagctgaccgtcctaggttct
agaggtggtggtggtagcggcggcggcggctctggtggtggtggatccctcgagatggcccaagtgcagctacagcagtgg
ggcgcaggactgttgaagcttcggagaccctgtccctcacctgcgctgtctatggtgggtccttcagtggttactactggagctg
gatccgccagccccaggaagggctggagtggattgggagatcactcatagtggaaggtccaactacaacccgtccctc
aagagtcgagtcaccatatcagtagacacgtccaagaaccagttctccctgaagctgagctctgtgaccgccgcggacacggc
cgtgtattactgtgcgcgctcttctatcatgtctgattactggggtcaaggtactctggtgaccgtctcctca [SEQ ID NO:
653]

Amino Acid Sequence
NFMLTQPHSVSESPGKTVTISCTGSSGSIASNYVQWYQQRPGSAPTTVIYEDNQR
PSGVPDRFSGSIDSSSNSASLTISGLKTEDEADYYCQSYDSSNHWVFGGGTKLTV
LGSRGGGGSGGGGSGGGGSLEMAQVQLQQWGAGLLKPSETLSLTCAVYGGSFS
GYYWSWIRQPPGKGLEWIGEITHSGRSNYNPSLKSRVTISVDTSKNQFSLKLSSVT
AADTAVYYCARSSIMSDYWGQGTLVTVSS [SEQ ID NO: 654]

TABLE 108

ET200-034

DNA Sequence
cagtctgtgttgacgcagccgccctcagtgtctggggcccccaggcagagggtcaccatctcctgcactgggagcacctccaa
catcggggcaggttatgatgtacactggtaccagcagcttccaggaacagccccaaactcctcatcaacaataacaggaatcg
gccctcaggggtccctgaccgattctctggctccaagtctggcacgtcagctcaccctgggcatcaccggactccagactgggg
acgaggccgattattactgcggaacatggatggcagcctgactggtgcagtgttcggcggagggaccaagctgaccgtccta
ggttctagaggtggtggtggtagcggcggcggcggctctggtggtggtggatccctcgagatggccgaggtccagctggtgc
agtctggggctgaggtgaagaagcctgggcctcggtgaaggtctcatgcaaggcttctggaggcaccttcagcagctatgcta
tcagctgggtgcgacaggcccctggacaagggcttgagtggatgggagggatcatccctatctttggtacagcaaactacgcac
agaagttccagggcagagtcacgattaccgcggacgaatccacgagcacagcctacatggagctgagcagcctgagatctga
ggacacggccgtgtattactgtgcgcgggttctgctctggaccattacgatcgttggggtcaaggtactctggtgaccgtctcct
ca [SEQ ID NO: 655]

Amino Acid Sequence
QSVLTQPPSVSGAPGQRVTISCTGSTSNIGAGYDVHWYQQLPGTAPKLLINNNRN
RPSGVPDRFSGSKSGTSATLGITGLQTGDEADYYCGTWDGSLTGAVFGGGTKLT
VLGSRGGGGSGGGGSGGGGSLEMAEVQLVQSGAEVKKPGSSVKVSCKASGGTF
SSYAISWVRQAPGQGLEWMGGIIPIFGTANYAQKFQGRVTITADESTSTAYMELS
SLRSEDTAVYYCARGSALDHYDRWGQGTLVTVSS [SEQ ID NO: 656]

TABLE 109

ET200-035

DNA Sequence
aatttatgctgactcagccccactctgtgtcggagtctccggggaagacggtaaccatctcctgcacccgcagcagtggcagca
ttgccagcaactatgtgcagtggtaccagcagcgcccgggcagtgccccaccactgtgatctatgaggataaccaaagaccct
ctggggtccctgatcggttctctggctccatcgacagctcctccaactctgcctccctcaccatctctggactgaagactgaggac
gaggctgactactactgtcagtcttatgatagcaccaattgggtgttcggcggagggaccaagctgaccgtcctaggttctagag
gtggtggtggtagcggcggcggcggctctggtggtggtggatccctcgagatggcccaggtgcagctggtgcagtctggggc
tgaggtgaagaagcctgggtcctcggtgaaggtctcctgcaaggcttctggaggcaccttcagcagctatgctatcagctgggt
gcgacaggcccctggacaagggcttgagtggatgggaggatcatccctatctttggtacagcaaactacgcacagaagttcc
agggcagagtcacgattaccgcggacgaatccacgagcacagcctacatggagctgagcagcctgagatctgaggacactgc
cgtgtattactgtgcgcgctacaactactacttcaacgattactgggtcaaggtactctggtgaccgtctcctca [SEQ ID
NO: 657]

Amino Acid Sequence
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSTNWVFGGGTKLTVLG
SRGGGGSGGGGSGGGGSLEMAQVQLVQSGAEVKKPGSSVKVSCKASGGTFSSY
AISWVRQAPGQGLEWMGGIIPIFGTANYAQKFQGRVTITADESTSTAYMELSSLR
SEDTAVYYCARYNYYFNDYWGQGTLVTVSS [SEQ ID NO: 658]

TABLE 110

ET200-037

DNA Sequence
tcctatgtgctgactcagccaccctcagtgtcagtggccccaggaaagacggccaggattacctgtgggggaaacaacattgga
agtaaaagtgtgcactggtaccagcagaagccaggccaggcccctgtgctggtcatctattatgatagcgaccggccctcagg
gatccctgagcgattctctggctccaactctgggaacacggccacccgaccatcagcagggtcgaagcggggatgaggcc
gactattactgtcaggtgtgggatagtagtagtgatcatccttatgtcttcggaactgggaccaaggtcaccgtcctaggttctaga
ggtggtggtggtagcggcggcggcggctctggtggtggtggatccctcgagatggcccagatgcagctggtgcagtctggag
ctgaggtgaagaagcctggggcctcagtgaaggtctcctgcaaggcttctggttacacctttaccagctatggtatcagctgggt
gcgacaggcccctggacaagggcttgagtggatgggatggatcagcgcttacaatggtaacacaaactatgcacagaagctc
agggcagagtcaccatgaccacagacacatccacgagcacagcctacatggagctgaggagcctgagatctgacgacactgc
cgtgtattactgtgcgcgctctatgttcggtgctcatgattcttgggtcaaggtactctggtgaccgtctcctca [SEQ ID
NO: 659]

Amino Acid Sequence
SYVLTQPPSVSVAPGKTARITCGGNNIGSKSVHWYQQKPGQAPVLVIYYDSDRPS
GIPERFSGSNSGNTATLTISRVEAGDEADYYCQVWDSSSDHPYVFGTGTKVTVLG
SRGGGGSGGGGSGGGGSLEMAQMQLVQSGAEVKKPGASVKVSCKASGYTFTS
YGISWVRQAPGQGLEWMGWISAYNGNTNYAQKLQGRVTMTTDTSTSTAYMEL
RSLRSDDTAVYYCARSMFGAHDSWGQGTLVTVSS [SEQ ID NO: 660]

TABLE 111

ET200-038

DNA Sequence
cagtctgtgttgacgcagccgccctcagtgtctggggcccaggcagagggtcaccatctcctgcactgggagcagctccaa
catcggggcaggttttgatgtacactggtaccagctacttccaggaacagccccaaactcctcatctatgctaacagcaatcgg
ccctcaggggtccctgaccgattctctggctccaagtctggcacctcagcctccctggccatcactgggctcctggctgaggatg
aggctgattattactgccagtcctatgacagcagcctgagtggtgtggtattcggcggagggaccaagctgaccgtcctaggttc
tagaggtggtggtggtagcggcggcggcggctctggtggtggtggatccctcgagatggcccaggtgcagctggtgcaatctg
gggctgaggtgaagaagcctgggtcctcggtgaaggtctcctgcaaggcttctggaggcaccttcagcagctatgctatcagct
gggtgcgacaggcccctggacaagggcttgagtggatgggaggatcatccctatctttggtacagcaaactacgcacagaag
ttccagggcagagtcacgattaccgcggacgaatccacgagcacagcctacatggagctgagcagcctgagatctgaggaca
ctgccgtgtattactgtgcgcgcggtgcttctttcgaccgtcatgataactggggtcaaggtactctggtgaccgtctcctca
[SEQ ID NO: 661]

Amino Acid Sequence
QSVLTQPPSVSGAPGQRVTISCTGSSNIGAGFDVHWYQLLPGTAPKLLIYANSN
RPSGVPDRFSGSKSGTSASLAITGLLAEDEADYYCQSYDSSLSGVVFGGGTKLTV
LGSRGGGGSGGGGSGGGGSLEMAQVQLVQSGAEVKKPGSSVKVSCKASGGTFS
SYAISWVRQAPGQGLEWMGGIIPIFGTANYAQKFQGRVTITADESTSTAYMELSS
LRSEDTAVYYCARGASFDRHDNWGQGTLVTVSS [SEQ ID NO: 662]

TABLE 112

ET200-039

DNA Sequence
aattttatgctgactcagccccactctgtgtcggagtctccggggaagacggtaaccatctcctgcacccgcagcagtggcagca
ttgccagcaactatgtgcagtggtaccagcagcgcccgggcagttcccccaccactgtgatctatgaggataaccaaagaccct
ctggggtccctgatcggttctctggctccatcgacagctcctccaactctgcctccctcaccatctctggactgaagactgaggac
gaggctgactactactgtcagtcttatgatagcagcaattgggtgttcggcggagggaccaagctgaccgtcctaggttctagag
gtggtggtggtagcggcggcggcggctctggtggtggtggatccctcgagatggccgaggtccagctggtgcagtctggggc
tgaggtgaagaagcctgggtcctcggtgaaggtctcctgcaaggcttctggaggcaccttcagcagctatgctatcagctgggt
gcgacaggcccctggacaagggcttgagtggatgggagggatcatccctatctttggtacagcaaactacgcacagaagttcc
agggcagagtcacgattaccgcggacgaatccacgagcacagcctacatggagctgagcagcctgagatctgaggacacgg
ccgtgtattactgtgcgcgctctaactactactacaacgattactggggtcaaggtactctggtgaccgtctcctca [SEQ ID NO: 663]

Amino Acid Sequence
NFMLTQPHSVSESPGKTVTISCTRSSGSIASNYVQWYQQRPGSSPTTVIYEDNQRP
SGVPDRFSGSIDSSSNSASLTISGLKTEDEADYYCQSYDSSNWVFGGGTKLTVLG
SRGGGGSGGGGSGGGGSLEMAEVQLVQSGAEVKKPGSSVKVSCKASGGTFSSY
AISWVRQAPGQGLEWMGGIIPIFGTANYAQKFQGRVTITADESTSTAYMELSSLR
SEDTAVYYCARSNYYYNDYWGQGTLVTVSS [SEQ ID NO: 664]

TABLE 113

ET200-040

DNA Sequence
cagtctgtgttgacgcagccgccctcagtgtctggggccccagggcagagggtcaccatctcctgcactgggagcagctccaa
catcggggcaggttatgatgtacactggtaccagcagcttccaggaacagcccccaaactcctcatctatggtaacagcaatcg
gccctcaggggtccctgaccgattctctggctccaagtctggcacctcagcctccctggccatcactgggctccaggctgagga
tgaggctgattattactgccagtcctatgacagcagcctgagtggttatgtcttcggaactgggaccaaggtcaccgtcctaggttc
tagaggtggtggtggtagcggcggcggcggctctggtggtggtggatccctcgagatggcccaggtgcagctggtgcagtct
gggctgaggtgaagaagcctggggcctcagtgaaggtctcctgcaaggtttccggatacacccctcactgaattatccatgcact
gggtgcgacaggcctcctggaaaagggcttgagtggatggaggttttgatcctgaagatggtgaaacaatctacgcacagaagt
tccagggcagagtcaccatgaccgaggacacatctacagacacagcctacatggagctgagcagcctgagatctgaggacac
tgccgtgtattactgtgcgcgctactctggtgtttactacgattggggtcaaggtactctggtgaccgtctcctca [SEQ ID NO: 665]

Amino Acid Sequence
QSVLTQPPSVSGAPGQRVTISCTGSSSNIGAGYDVHWYQQLPGTAPKLLIYGNSN
RPSGVPDRFSGSKSGTSASLAITGLQAEDEADYYCQSYDSSLSGYVFGTGTKVTV
LGSRGGGGSGGGGSGGGGSLEMAQVQLVQSGAEVKKPGASVKVSCKVSGYTLT
ELSMHWVRQAPGKGLEWMGGFDPEDGETIYAQKFQGRVTMTEDTSTDTAYME
LSSLRSEDTAVYYCARYSGVYYDWGQGTLVTVSS [SEQ ID NO: 666]

TABLE 114

ET200-041

DNA Sequence
aattttatgctgactcagccccactctgtgtcggggtctccggggaagacggtaaccatctcctgcaccggcagcagtggcagc
attgccgacaactttgtgcagtggtaccagcagcgcccgggcggtgtccccaccactgtgatctttaatgatgacgaaagaccct
ctggcgtccctgatcggttctctggctccatcgacacctcctccaattctgcctccctcaccatctctggactgaagactgaggacg
aggctgactactactgtcagtcttatgataataataatcgaggggtgttcggcggagggaccaagctgaccgtcctaggttctaga
ggtggtggtggtagcggcggcggcggctctggtggtggtggatccctcgagatggcccaggtccagctggtgcagtctgggg
ctgaggtgaagaagcctgggtcctcggtgaaggtctcctgcaaggcttctggaggcaccttcagcagctatgctatcagctgggt
gcgacaggcccctggacaagggcttgagtggatgggatggatgaaccctaacagtggtaacacaggctatgcacagaagttc
cagggcagagtcaccatgaccaggaacacctccataagcacagcctacatggagctgagcaacctgagatctgaggacacgg
ccgtgtattactgtgcgcgctactactcttacggttacgattggggtcaaggtactctggtgaccgtctcctca [SEQ ID NO: 667]

Amino Acid Sequence
NFMLTQPHSVSGSPGKTVTISCTGSSGSIADNFVQWYQQRPGGVPTTVIFNDDER
PSGVPDRFSGSIDTSSNSASLTISGLKTEDEADYYCQSYDNNRGVFGGGTKLTV
LGSRGGGGSGGGGSGGGGSLEMAQVQLVQSGAEVKKPGSSVKVSCKASGGTFS
SYAISWVRQAPGQGLEWMGWMNPNSGNTGYAQKFQGRVTMTRNTSISTAYME
LSNLRSEDTAVYYCARYYSYGYDWGQGTLVTVSS [SEQ ID NO: 668]

TABLE 115

ET200-042

DNA Sequence
cagtctgtcgtgacgcagccgccctcagtgtctggggccccagggcagacggtcaccatctcctgcactgggggcagctccaa
catcgggacaggttatttttgtaaattggtaccagcaggttccaggaaaagccccaaactcctcatcctgggtaacaataatcggc
cctcgggggtccctgaccgactctccggctccacgtccggcacctcagcctccctggccatcactgggctccaggctgaggat
gagggtacttattactgccagtcctatgacagcagcctgagtggttatgtcttcggaactgggaccaaggtcaccgtcctaggttct
agaggtggtggtggtagcggcggcggcggctctggtggtggtggatccctcgagatggcccaggtacagctgcagcagtcag
gtccaggactggtgaagccctcgcagaccctctcactcacctgtggcatctccggggacagtgtctctaccaacagtgttgcttg
gcactggatcaggcagtccccatcgagaggccttgagtggctgggaaggacatactacaggtccaagtggtctaatgactatgg
agtatctgtgaaaagtcgaatcaccatcatcccagacacatccaagaaccagttctccctgcagctgaactctgtgactcccgag
gacacggctgtgtattactgtgcgcgctcttcttcttggtaccagatcttcgattactggggtcaaggtactctggtgaccgtctcctc
a [SEQ ID NO: 669]

Amino Acid Sequence
QSVVTQPPSVSGAPGQTVTISCTGGSSNIGTGYFVNWYQQVPGKAPKLLILGNNN
RPSGVPDRLSGSTSGTSASLAITGLQAEDEGTYYCQSYDSSLSGYVFGTGTKVTV
LGSRGGGGSGGGGSGGGGSLEMAQVQLQQSGPGLVKPSQTLSLTCGISGDSVST
NSVAWHWIRQSPSRGLEWLGRTYYRSKWSNDYGVSVKSRITIIPDTSKNQFSLQL
NSVTPEDTAVYYCARSSSWYQIFDYWGQGTLVTVSS [SEQ ID NO: 670]

TABLE 116

ET200-043

DNA Sequence
aatttatgctgactcagcccccactctgtgtcggagtctccggggaagacggtaaccatctcctgcaccggcagcagcgacagc
atagccaacaactatgttcagtggtaccagcagcgcccgggcagtgcccccaccaatgtgatctacgaagatgtccaaagacc
ctctggggtccctgatcggttctctgggtccatcgacagctcctccaactctgcctccctcaccatctctggactgaagactgagg
acgaggctgtctactattgtcagtcttatcatagcgacaatcgttgggtgttcggcggcgggaccaagctgaccgtcctaggttct
agaggtggtggtggtagcggcggcggcggctctggtggtggtggatccctcgagatggcccaggtgcagctggtggagtctg
ggggaggcttggtacagcctggggggtccctgagactctcctgtgcagcctctggattcaccttagcagctatgccatgagctg
ggtccgccaggctccagggaaggggctggagtgggtctcagctattagtggtagtggtggtagcacatactacgcagactccg
tgaagggccggttcaccatctccagagacaattccaagaacacgctgtatctgcaaatgaacagcctgagagccgaggacacg
gccgtatattactgtgcgcgctctggtgcttactgggactactctgtttacgatgaatggggtcaaggtactctggtgaccgtctcct
ca [SEQ ID NO: 671]

Amino Acid Sequence
NFMLTQPHSVSESPGKTVTISCTGSSDSIANNYVQWYQQRPGSAPTNVIYEDVQR
PSGVPDRFSGSIDSSSNSASLTISGLKTEDEAVYYCQSYHSDNRWVFGGGTKLTV
LGSRGGGGSGGGGSGGGGSLEMAQVQLVESGGGLVQPGGSLRLSCAASGFTFSS
YAMSWVRQAPGKGLEWVSAISGSGGSTYYADSVKGRFTISRDNSKNTLYLQMN
SLRAEDTAVYYCARSGAYWDYSVYDEWGQGTLVTVSS [SEQ ID NO: 672]

TABLE 117

ET200-044

DNA Sequence
cagtctgtgttgactcagccaccctcagtgtccgtgtccccaggacagacagccaccatcgcctgttctggacataaattggggg
ataaatatgcttcctggtatcagcagaagtcgggccagtcccctgttgatcatcatcaggataataagcggccctcagggattc
ctgagcgattctctggctccaactctgggaacacagccactctgaccatcagcgggacccaggctctggatgaggctgactatta
ttgtcaggcgtgggacagtagtacttatgtggcattcggcggagggaccaagctgaccgtcctaggttctagaggtggtggtggt
agcggcggcggcggctctggtggtggtggatccctcgagatggcccaggtgcagctgcaggagtccggcccaggactggtg
aagccttcggagaccctgtccctcacctgcgttgtctctggtggccatcagcagtagtaactggtggagctgggtccgccagc
ccccaggaaggggctggagtggattgggaaatctatcatagtgggagccccaactacaacccatccctcaagagtcgagtc
accatatcagtagacaagtccaagaaccagttctccctgaagctgagctctgtgaccgccgcggacacggccgtgtattactgtg
cgcgcatgactactcatactttcggttacgatgcttggggtcaaggtactctggtgaccgtctcctca [SEQ ID NO: 673]

Amino Acid Sequence
QSVLTQPPSVSVSPGQTATIACSGHKLGDKYASWYQQKSGQSPVLIIYQDNKRPS
GIPERFSGSNSGNTATLTISGTQALDEADYYCQAWDSSTYVAFGGGTKLTVLGSR
GGGGSGGGGSGGGGSLEMAQVQLQESGPGLVKPSETLSLTCVVSGGSISSSNWW
SWVRQPPGKGLEWIGEIYHSGSPNYNPSLKSRVTISVDKSKNQFSLKLSSVTAAD
TAVYYCARMTTHTFGYDAWGQGTLVTVSS [SEQ ID NO: 674]

TABLE 118

| ET200-045 |
|---|

DNA Sequence
cagcctgtgctgactcagccaccctcagtgtcagtggccccaggaaagacggccacgattacttgtgggggaaacaacattgg
aagtgaaagtgtgcactggtaccaccagaagccaggccaggcccctgtgttggtcatctatgatgatgccggccggccctcag
ggatccctgagcgattcactggctccaactctgggaacacggccaccctgaccatcagcagggtcgaagccggggatgaggc
cgactattactgtcaggtgtgggacagaaatagtgctcagtttgtcttcggacctgggaccaaggtcaccgtcctaggttctagag
gtggtggtggtagcggcggcggcggctctggtggtggtggatccctcgagatggccgaggtccagctggtgcagtctggagc
tgaggtgaagaagcctggggcctcagtgaaggtctcctgcaaggcttctggttacacctttaccagctatggtatcagctgggtg
cgacaggcccctggacaagggcttgagtggatgggatggatcagcgcttacaatggtaacacaaactatgcacagaagctcca
gggcagagtcaccatgaccacagacacatccacgagcacagcctacatggagctgaggagcctgagatctgacgacacggc
cgtgtattactgtgcgcgcggtgttcatctggattggtggggtcaaggtactctggtgaccgtctcctca [SEQ ID NO: 675]

Amino Acid Sequence
QPVLTQPPSVSVAPGKTATITCGGNNIGSESVHWYHQKPGQAPVLVIYDDAGRPS
GIPERFTGSNSGNTATLTISRVEAGDEADYYCQVWDRNSAQFVFGPGTKVTVLG
SRGGGGSGGGGSGGGGSLEMAEVQLVQSGAEVKKPGASVKVSCKASGYTFTSY
GISWVRQAPGQGLEWMGWISAYNGNTNYAQKLQGRVTMTTDTSTSTAYMELR
SLRSDDTAVYYCARGVHLDWWGQGTLVTVSS [SEQ ID NO: 676]

TABLE 119

| ET200-069 |
|---|

DNA Sequence
cagtctgtcgtgacgcagccaccctcagcgtctgggaccccgggcagagggtcaccatctcttgttctggaagcagctccaac
atcggaagtaattatgtatactggtaccagcagctcccaggaacggcccccaaactcctcatctatagtaataatcagcggccctc
aggggtccctgaccgattctctggctccaagtctggcacctcagcctccctggccatcagtgggctccggtccgaggatgaggc
tgattattactgtgcagcatgggatgacagcctgagtggttatgtcttcggaactgggaccaagctgaccgtcctaggttctagag
gtggtggtggtagcggcggcggcggctctggtggtggtggatccctcgagatggccaggtgcagctacagcagtggggcg
caggactgttgaagccttcggagaccctgtccctcacctgcgctgtctatggtgggtccttcagtggttactactggagctggatc
cgccagcccccagggaagggactggagtggattgggaaatcaatcatagtggaagcaccaactacaacccgtccctcaaga
gtcgagtcaccatatcagtagacacgtccaagaaccagttctccctgaagctgagctctgtgaccgccgcggacacggccgtgt
attactgtgcgcgcctgtacgaaggtggttaccatggttgggttcttggctgtcttctgattcttggggtcaaggtactctggtgac
cgtctcctca [SEQ ID NO: 677]

Amino Acid Sequence
QSVVTQPPSASGTPGQRVTISCSGSSSNIGSNYVYWYQQLPGTAPKLLIYSNNQRP
SGVPDRFSGSKSGTSASLAISGLRSEDEADYYCAAWDDSLSGYVFGTGTKLTVL
GSRGGGGSGGGGSGGGGSLEMAQVQLQQWGAGLLKPSETLSLTCAVYGGSFSG
YYWSWIRQPPGKGLEWIGEINHSGSTNYNPSLKSRVTISVDTSKNQFSLKLSSVT
AADTAVYYCARLYEGGYHGWGSWLSSDSWGQGTLVTVSS [SEQ ID NO: 678]

TABLE 120

| ET200-078 |
|---|

DNA Sequence
cagtctgtgttgactcagccaccctcagcgtctgggaccccgggcagagggtcaccatctcttgttctggaagcagctccaaca
tcggaagtaatactgtaaactggtaccagcagctcccaggaacgccccccaaactcctcatctatagtaataatcagcggccctc
aggggtccctgaccgattctctggctccaagtctggcacctcagcctccctggccatcagtgggctccagtctgaggatgaggct
gattattactgtgcagcatgggatgacagcctgaatggttattgggtgttcggcggagggaccaagctgaccgtcctaggttctag
aggtggtggtggtagcggcggcggcggctctggtggtggtggatccctcgagatggccaggtgcagctacagcagtgggg
cgcaggactgttgaagccttcggagaccctgtccctcacctgcgctgtctatggtgggtccttcagtggttactactggagctgga
tccgccagcccccagggaagggctggagtggattgggaaatcaatcatagtggaagcaccaactacaacccgtccctcaa
gagtcgagtcaccatatcagtagacgtccaagaaccagttctccctgaagctgagctctgtgaccgccgcggacacggctgt
gtattactgtgcgcgcgaagggcatttgatgcttttgatatctggggccaagggacaatggtcaccgtctcttca [SEQ ID NO: 679]

Amino Acid Sequence
QSVLTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYWVFGGGTKLTV
LGSRGGGGSGGGGSGGGGSLEMAQVQLQQWGAGLLKPSETLSLTCAVYGGSFS
GYYWSWIRQPPGKGLEWIGEINHSGSTNYNPSLKSRVTISVDTSKNQFSLKLSSV
TAADTAVYYCAREGAFDAFDIWGQGTMVTVSS [SEQ ID NO: 680]

TABLE 121

ET200-079

DNA Sequence
tcctatgagctgactcagccaccctcagcgtctgggaccccgggcagagggtcaccatctcttgttctggaagcagctccaac
atcggaagtaattatgtatactggtaccagcagctcccaggaacggcccccaaactcttcatctataggaataatcagcggccctc
aggggtccctgaccgattctctggctccaagtctggcacctcagcctccctggccatcagtgggctccggtccgaggatgaggc
tgattattactgtgcagcatgggatgacagcctgagtggttatctcttcggaactgggaccaaggtcaccgtcctaggttctagag
gtggtggtggtagcggcggcggcggctctggtggtggtggatccctcgagatggccgaggtgcagctggtggagtctgggggg
aggcttggtacagcctggcaggtccctgagactctcctgtgcagcctctggattcacctttgatgattatgccatgcactgggtccg
gcaagctccagggaagggcctggagtgggtctcaggtattagttggaatagtggtagcataggctatgcggactctgtgaaggg
ccgattcaccatctccagagacaacgccaagaaccccctgtatctgcaaatgaacagtctgagagctgaggacacggccttgtat
tactgtgcaaatggcgactccaactactactacggtatggacgtctggggccaagggaccacggtcaccgtctcctca [SEQ
ID NO: 681]

Amino Acid Sequence
SYELTQPPSASGTPGQRVTISCSGSSSNIGSNYVYWYQQLPGTAPKLFIYRNNQRP
SGVPDRFSGSKSGTSASLAISGLRSEDEADYYCAAWDDSLSGYLFGTGTKVTVL
GSRGGGGSGGGGSGGGGSLEMAEVQLVESGGGLVQPGRSLRLSCAASGFTFDD
YAMHWVRQAPGKGLEWVSGISWNSGSIGYADSVKGRFTISRDNAKNSLYLQMN
SLRAEDTALYYCANGDSNYYYGMDVWGQGTTVTVSS [SEQ ID NO: 682]

TABLE 122

ET200-081

DNA Sequence
cagtctgccctgactcagcctgcctccgtgtccgggtctcctggacagtcgatcaccatctcctgcactggaaccagcagtgaca
ttggtggttataactatgtctcctggtaccaacaacacccaggcaaagcccccaaactcatgatttatgatgtcagtaatcggccct
caggggtttctaatcgcttctctggctccaagtctggcaacacggcctccctgaccatctctgggctccaggctgaggacgaggc
tgattattactgcatctcatatacacgcacctggaaccctatgtcttcgggagtgggaccaaggtcaccgtcctaggttctagagg
tggtggtggtagcggcggcggcggctctggtggtggtggatccctcgagatggccgaggtgcagctggtgcagtctgggggga
ggcgtggtacagcctgggggtccctgagactctcctgtgcagcctctggattcacctttgatgattatgccatgcactgggtccg
tcaagctccagggaagggtctggagtgggtctctcttattagtggggatggtggtagcacatactatgcagactctgtgaagggc
cgattcaccatctccagagacaacagcaaaaactccctgtatctgcaaatgaacagtctgagaactgaggacaccgccttgtatt
actgtgcaaaagatcgggcagcagctggctactactactacggtatggacgtctggggccaagggaccacggtcaccgtctcc
tca [SEQ ID NO: 683]

Amino Acid Sequence
QSALTQPASVSGSPGQSITISCTGTSSDIGGYNYVSWYQQHPGKAPKLMIYDVSN
RPSGVSNRFSGSKSGNTASLTISGLQAEDEADYYCISYTRTWNPYVFGSGTKVTV
LGSRGGGGSGGGGSGGGGSLEMAEVQLVQSGGGVVQPGGSLRLSCAASGFTFD
DYAMHWVRQAPGKGLEWVSLISGDGGSTYYADSVKGRFTISRDNSKNSLYLQM
NSLRTEDTALYYCAKDRAAAGYYYYGMDVWGQGTTVTVSS [SEQ ID NO: 684]

TABLE 123

ET200-097

DNA Sequence
ctgcctgtgctgactcagccaccctcagtgtccgtgtccccaggacagacagccatcatcacctgctctggagataaattggggg
aaaaatatgtttcctggtatcagcagaagccaggccagtcccctgtactggtcatcgatcaagataccaggaggccctcagggat
ccctgagcgattctctggctccaactctgggaccacagccactctgaccatcagcgggacccaggctatggatgaggctgacta
ttactgtcaggcgtgggacaggggtgtggtattcggcggagggaccaagctgaccgtcctaggttctagaggtggtggtggtag
cggcggcggcggctctggtggtggtggatccctcgagatggccgaggtgcagctggtggagtctgggggagacttggtacag
cctggcaggtccctgagactctcctgtgcagcctctggattcacctttaatgattatgccatgcactgggtccggcaagctccagg
gaagggcctggagtgggtctcaggtattagttggagtggtaataacataggctatgcggactctgtgaagggccgattcaccatc
tccagagacaacgccaagaaccccctgtatctgcaaatgaacagtctgagagctgaggacacggccttgtattactgtgcaaaa
gatagtatacggtatggcatcacctggggaggttttgactactggggccagggaaccctggtcaccgtctcctca [SEQ ID
NO: 685]

Amino Acid Sequence
LPVLTQPPSVSVSPGQTAIITCSGDKLGEKYVSWYQQKPGQSPVLVIDQDTRRPS
GIPERFSGSNSGTTATLTISGTQAMDEADYYCQAWDRGVVFGGGTKLTVLGSRG
GGGSGGGGSGGGGSLEMAEVQLVESGGDLVQPGRSLRLSCAASGFTFNDYAMH
WVRQAPGKGLEWVSGISWSGNNIGYADSVKGRFTISRDNAKNSLYLQMNSLRA
EDTALYYCAKDSIRYGITWGGFDYWGQGTLVTVSS [SEQ ID NO: 686]

TABLE 124

ET200-098

DNA Sequence
cagcctgtgctgactcagccaccctcggtgtccaagggcttgagacagaccgccacactcacctgcactgggaacagcaacaa
tgttggcaacctaggagtagcttggctgcagcagcaccagggccaccctcccaaactcctatcctacaggaataacaaccggc
cctcagggatctcagagagattatctgcatccaggtcaggaaacacagcctccctgaccattactggactccagcctgaggacg
aggctgactattactgctcagcatgggacagtagcctcagtgcttgggtgttcggcggagggaccaagctgaccgtcctaggttc
tagaggtggtggtggtagcggcggcggcggctctggtggtggtgatccctcgagatggccgaggtgcagctggtggagtct
gggggagtcgtggtacagcctgggggggtccctgagactctcctgtgcagcctctggattcacctttgatgattatgccatgcactg
ggtccgtcaagctccggggaagggtctggagtgggtctctcttattaatttgggatggtggtagcacctactatgcagactctgtga
agggtcgattcaccatctccagagacaacagcaaaaactccctgtatctgcaaatgaacagtctgagagctgaggacaccgcct
tgtattactgtgcaaaagggatgggcctgagggcgtttgactactggggccagggaaccctggtcaccgtctcctca [SEQ
ID NO: 687]

Amino Acid Sequence
QPVLTQPPSVSKGLRQTATLTCTGNSNNVGNLGVAWLQQHQGHPPKLLSYRNN
NRPSGISERLSASRSGNTASLTITGLQPEDEADYYCSAWDSSLSAWVFGGGTKLT
VLGSRGGGGSGGGGSGGGGSLEMAEVQLVESGGVVVQPGGSLRLSCAASGFTF
DDYAMHWVRQAPGKGLEWVSLINWDGGSTYYADSVKGRFTISRDNSKNSLYL
QMNSLRAEDTALYYCAKGMGLRAFDYWGQGTLVTVSS [SEQ ID NO: 688]

TABLE 125

ET200-099

DNA Sequence
cagtctgtgttgactcagccaccctcagcgtctgggaccccgggcagagggtcaccatctcctgttctggaagcagctccaac
atcggaagtaatactgtaaactggtaccagcagctcccaggaacggccccaaactcctcatctatagtaatgatcagcggcct
caggggtccctgaccgattctctggctccaagtccggcacctcagcctccctggccatcagtgggctccagtctgaggatgagg
ctgattattactgtgcttcatgggatgacagcctgaatggccgttatgtcttcggaactgggaccaaggtcaccgtcctaggttcta
gaggtggtggtggtagcggcggcggcggctctggtggtggtgatccctcgagatggccaggtccagctggtacagtctgg
ggctgaggtgaggaagcctggggcctcagtgaaggtttcctgcaagacttctggatacaccttcagttggtatgctatacattggg
tgcgccaggcccccggacaaaaggcttgagtggatgggatggatcaacggtggcaatggaaacacaaaatattcacagaaattt
cagggcagagtcagtcttaccagggacacatccgcgagcacagcctacatggagctgagcagcctgagatctgatgacacgg
ctgtgtattactgtgcgagacccgataattatggttcgggtggggatgttttgatatctggggccaagggacaatggtcaccgtct
cttca [SEQ ID NO: 689]

Amino Acid Sequence
QSVLTQPPSASGTPGQRVTISCSGSSSNIGSNTVNWYQQLPGTAPKLLIYSNDQRP
SGVPDRFSGSKSGTSASLAISGLQSEDEADYYCASWDDSLNGRYVFGTGTKVTV
LGSRGGGGSGGGGSGGGGSLEMAQVQLVQSGAEVRKPGASVKVSCKTSGYTFS
WYAIHWVRQAPGQRLEWMGWINAGNGNTKYSQKFQGRVSLTRDTSASTAYME
LSSLRSDDTAVYYCARPDNYGSGGDVFDIWGQGTMVTVSS [SEQ ID NO: 690]

TABLE 126

ET200-100

DNA Sequence
aattttatgctgactcagccccactctgtgtcggagtctccggggaagacggtaaccatctcctgcacccgcagcagtggcagca
ttgccagcaactttgtgcagtggtaccagcagcgcccgggcagtgccccacccctatgatctatgaggataacaacagaccccc
ctggggtccctgatcggttctctgcctccgtcgacagctcctccaactctgcctccctcaccatctctggactgaagactgaggac
gaggctgactactactgtcagtcttatgataccagcaatgtggtattcggcggagggaccaagctgaccgtcctaggttctagag
gtggtggtggtagcggcggcggcggctctggtggtggtgatccctcgagatggccgaggtgcagctggtggagtctggggg
aggcttggtacagcctggagggtccctgagactctcctgtgcagcctctggattcaccttcagtagttatgaaatgaactgggtcc
gccaggctccagggaaggggctggagtgggtttcatacattagtagtagtggtagtaccatatactacgcagactctgtgaagg
gccgattcaccatctccagagacaacgccaagaactcactgtatctgcaaatgaacagcctgagagccgaggacacggctgttt
attactgtgcacgctgggactacggtatggacgtctggggccaagggaccacggtcaccgtctcctca [SEQ ID NO:
691]

Amino Acid Sequence
NFMLTQPHSVSESPGKTVTISCTRSSGSIASNFVQWYQQRPGSAPTPMIYEDNNRP
PGVPDRFSASVDSSSNSASLTISGLKTEDEADYYCQSYDTSNVVFGGGTKLTVLG
SRGGGGSGGGGSGGGGSLEMAEVQLVESGGGLVQPGGSLRLSCAASGFTFSSYE
MNWVRQAPGKGLEWVSYISSSGSTIYYADSVKGRFTISRDNAKNSLYLQMNSLR
AEDTAVYYCARWDYGMDVWGQGTTVTVSS [SEQ ID NO: 692]

TABLE 127

ET200-101

DNA Sequence
caggctgtgctgactcagccaccctcagcgtctggggcccccgggcagagggtcaccgtctcttgttctggaagcaactccaac
atcggaagtaactacgttaactggtaccagcagttcccaggaacggccccaaactcctcatgtatagtagtagtcagcggccct
caggggtccctgaccgattctctggctccaagtctggcacctcagcctcctggccatcagtgggctccactctgaggatgagg
ctgattattactgtgctacatgggatgacagcctgaatgcttgggtgttcggcggagggaccaagctgaccgtcctaggttctaga
ggtggtggtggtagcggcggcggcggctctggtggtggtggatccctcgagatggccgaggtccagctggtgcagtctgggg
ctgaggtgaggaagcctggggcctcagtgaaggtttcctgcaagacttctggatacaccttcacttggtatgctatacattgggtg
cgccaggcccccggacaaaggcttgagtggatgggatggatcaacgctggcagtggaaacacaaaatattcacagaaatttca
gggcagagtcaccctaccagggacacatccgcgagcacagcgtacatggagctgagcagcctgagatctgatgacacggct
gtgtattactgtgcgagacccaataactatggttcgggtggggatgttttgatatctggggccaagggacaatggtcaccgtctct
tca [SEQ ID NO: 693]

Amino Acid Sequence
QAVLTQPPSASGAPGQRVTVSCSGSNSNIGSNYVNWYQQFPGTAPKLLMYSSSQ
RPSGVPDRFSGSKSGTSASLAISGLHSEDEADYYCATWDDSLNAWVFGGGTKLT
VLGSRGGGGSGGGGSGGGGSLEMAEVQLVQSGAEVRKPGASVKVSCKTSGYTF
TWYAIHWVRQAPGQRLEWMGWINAGSGNTKYSQKFQGRVTLTRDTSASTAYM
ELSSLRSDDTAVYYCARPNNYGSGGDVFDIWGQGTMVTVSS [SEQ ID NO: 694]

TABLE 128

ET200-102

DNA Sequence
cagtctgtcgtgacgcagccgccctcagtgtctgcggccccaggacagaaggtcaccatctcctgctctggaagcagctccaa
cattgggaataattatgtatcctggtaccagcagctcccaggaacgcccccaaactcctcatttatgacaataataagcgaccct
caggggattcctgaccgattctctggctccaagtctggcacgtcagccaccctgggcatcaccggactccagactggggacgag
gccgattattactgcgaacatggggatagcagcctgagtgcttatgtcttcggaactgggaccaaggtcaccgtcctaggttctag
aggtggtggtggtagcggcggcggcggctctggtggtggtggatccctcgagatggcccaggtccagctggtgcagtctggg
gctgaggtgaagaagcctggggcctcagtgaaagtttcctgcaaggcttctggatacaccttcacgaactatgctctgcattggt
gcgccaggcccccggacaaaggtcttgagtggatgcatggcatggattaacgggggcaatggtaacacaaaatattcacagaacttcc
agggcagagtcaccattaccagggacacatccgcgagcacagcctatatggagctgagcagcctgagatctgaagacacggc
tgtgtattactgtgcgaaaccggaggaaacagctggaacaatccactttgactactggggccagggaaccccggtcaccgtctc
ctca [SEQ ID NO: 695]

Amino Acid Sequence
QSVVTQPPSVSAAPGQKVTISCSGSSSNIGNNYVSWYQQLPGTAPKLLIYDNNKR
PSGIPDRFSGSKSGTSATLGITGLQTGDEADYYCGTWDSSLSAYVFGTGTKVTVL
GSRGGGGSGGGGSGGGGSLEMAQVQLVQSGAEVKKPGASVKVSCKASGYTFT
NYALHWVRQAPGQGLEWMAWINGGNGNTKYSQNFQGRVTITRDTSASTAYME
LSSLRSEDTAVYYCAKPEETAGTIHFDYWGQGTPVTVSS [SEQ ID NO: 696]

TABLE 129

ET200-103

DNA Sequence
caggctgtgctgactcagccccactctgtgtcggagtctccggggaagacggtaaccatctcctgcacccgcagcagtggcag
cattgccagcaactatgtgcagtggtaccagcagcgcccgggcagtgccccaccactgtgatctatgaggataaccaaagac
cctctggggtccctgatcggttctctggctccatcgacagctcctccaactctgcctccctcaccatctctggactgaagactgag
gacgaggctgactactactgtcagtcttatgatagcaccatcacggtgttcggcggagggaccaagctgaccgtcctaggttcta
gaggtggtggtggtagcggcggcggcggctctggtggtggtggatccctcgagatggcccaggtccagctggtacagtctgg
ggctgaggtgaagaagcctgggtcctcggtgaaggtctcctgcaaggcttctggaggcaccttcagcagctatgctatcagctg
ggtgcgacaggcccctggacaagggcttgagtggatgggagggatcatccctatctttggtacagcaaactacgcacagaagtt
ccagggcagagtcacgattaccgcggacgaatccacgagcacagcctacatggagctgagcagcctgagatctgaggacac
ggccgtgtattactgtgcggggagggttactatgatagtggttattccaacggtgatgcttttgatatctggggccaagggaca
atggtcaccgtctcttca [SEQ ID NO: 697]

Amino Acid Sequence
QAVLTQPHSVSESPGKTVTISCTRSSGSIASNYVQWYQQRPGSAPTTVIYEDNQRP
SGVPDRFSGSIDSSSNSASLTISGLKTEDEADYYCQSYDSTITVFGGGTKLTVLGS
RGGGGSGGGGSGGGGSLEMAQVQLVQSGAEVKKPGSSVKVSCKASGFSSYA
ISWVRQAPGQGLEWMGGIIPIFGTANYAQKFQGRVTITADESTSTAYMELSSLRS
EDTAVYYCAGEGYYDSSGYSNGDAFDIWGQGTMVTVSS [SEQ ID NO: 698]

TABLE 130

ET200-104

DNA Sequence
aatttatgctgactcagccccactctgtgtcggagtctccggggaagacggtaaccatctcctgcacccgcagcagtggcagca
ttgccagcaactatgtgcagtggtaccagcagcgcccgggcagtgccccaccactgtgatctatgaggataaccaaagaccct
ctggggtccctgatcggttctctggctccatcgacagctcctccaactctgcctccctcaccatctctggactgaagactgaggac
gaggctgactactactgtcagtcttatgatagcagcaatgtggtattcggcggagggaccaaggtcaccgtcctaggttctagag
gtggtggtggtagcggcggcggcggctctggtggtggtggatccctcgagatggccgaggtgcagctggtggagtctggggg
aggcttggtacagcctggagggtccctgagactctcctgtgcagcctctggattcaccttcagtagttatgaaatgaactgggtcc
gccaggctccagggaagggctggagtgggtttcatacattagtagtagtggtagtaccatatactacgcagactctgtgaagg
gccgattcaccatctccagagacaacgccaagaactcactgtatctgcaaatgaacagcctgagagccgaggacacggctgttt
attactgtgcacgctgggactacggtatggacgtctgggccaagggaccacggtcaccgtctcctca [SEQ ID NO: 699]

Amino Acid Sequence
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSSNVVFGGGTKVTVLGS
RGGGGSGGGGSGGGGSLEMAEVQLVESGGGLVQPGGSLRLSCAASGFTFSSYE
MNWVRQAPGKGLEWVSYISSSGSTIYYADSVKGRFTISRDNAKNSLYLQMNSLR
AEDTAVYYCARWDYGMDVWGQGTTVTVSS [SEQ ID NO: 700]

TABLE 131

ET200-105

DNA Sequence
tcctatgtgctgactcagccaccctcagtgtccgtgtccccaggacagacagccagcatcacctgctctggagatagattgacga
ataaatatgtttcctggtatcaacagaagccaggccagtccctgtgttggtcatctatgaggatgccaagcggccctcagggatc
cctgcgcgattctctggctccaactctgggaacacagccactctgaccatcagcgggacccaggctatggatgagtctgaatatt
actgtcaggcgtgggacagcagtgtggtgttttggcggagggaccaagctgaccgtcctaggttctagaggtggtggtggta
gcggcggcggcggctctggtggtggtggatccctcgagatggccgaggtgcagctggtggagtctggggaggcttggtaca
gcctggcaggtccctgagactctcctgtgcagcctctggatttacctttgatgattatgccatgcactgggtccggcaagctccag
ggaaggcctggagtgggtctcaggtattagttggaatagtggtagtataggctatgcggactctgtgaagggccgattcaccat
ctccagagacaacgccaagaactccctgtatctgcaaatgaacagtctgagagatgaggacacggccttgtattactgtgcaaaa
gaccgagggggggagttatcgttaaggatgcttttgatatctggggccaagggacaatggtcaccgtctcttca [SEQ ID NO: 701]

Amino Acid Sequence
SYVLTQPPSVSVSPGQTASITCSGDRLTNKYVSWYQQKPGQSPVLVIYEDAKRPS
GIPARFSGSNSGNTATLTISGTQAMDESEYYCQAWDSSVVVFGGGTKLTVLGSR
GGGGSGGGGSGGGGSLEMAEVQLVESGGGLVQPGRSLRLSCAASGFTFDDYAM
HWVRQAPGKGLEWVSGIWNSGSIGYADSVKGRFTISRDNAKNSLYLQMNSLR
DEDTALYYCAKDRGGGVIVKDAFDIWGQGTMVTVSS [SEQ ID NO: 702]

TABLE 132

ET200-106

DNA Sequence
tcctatgagctgactcagccacccgcagcgtctgggaccccggacagagagtcaccatctcttgttctgggggcgtctccaac
atcgggagtggtgctctaaattggtaccagcaactcccaggaacggcccccaaactcctcatctatagttacaatcagcggccct
caggggtctctgaccgattctctggctccaggtctgccacctcagcctccctggccatcagtgggctccagtctgaggatgaggc
tgattattactgtgcaacctgggatgatagtgtgaatggttgggtgttcggcggagggaccaagctgaccgtcctaggttctagag
gtggtggtggtagcggcggcggcggctctggtggtggtggatccctcgagatggccgaggtgcagctggtggagtctggagc
tgaggtgaagaagcctggggattcagtgaaggtctcctgcaagccttctggttacaattttctcaactatggtatcaactgggtgcg
acaggcccctggacaagggcttgagtggatgggatggattagcacttacaccggtaacacaaactatgcacagaagctgcagg
gcagagtcaccttcaccacagacacatccacgagcacagcctacatggagatgaggagcctgagatctgacgacacggccgt
gtattactgtgcgcgccagcagggtggtggttggtacgatgtttgggtcaaggtactctggtcaccgtctcctca [SEQ ID NO: 703]

Amino Acid Sequence
SYELTQPPAASGTPGQRVTISCSGGVSNIGSGALNWYQQLPGTAPKLLIYSYNQR
PSGVSDRFSGSRSATSASLAISGLQSEDEADYYCATWDDSVNGWVFGGGTKLTV
LGSRGGGGSGGGGSGGGGSLEMAEVQLVESGAEVKKPGDSVKVSCKPSGYNFL
NYGINWVRQAPGQGLEWMGWISTYTGNTNYAQKLQGRVTFTTDTSTSTAYME
MRSLRSDDTAVYYCARQQGGGWYDVWGQGTLVTVSS [SEQ ID NO: 704]

TABLE 133

| ET200-107 |
|---|

DNA Sequence
cagtctgtcgtgacgcagccgccctcagtgtctgcggccccaggagagaaggtcaccatctcctgctctggaagcaacttcaat
gttggaaataatgatgtatcctggtatcagcaactcccaggtgcagcccccaaactcctcatttatgacaataataagcgaccctca
gggattcctgaccgattctctggctccaagtctggcacgtcagccaccctggacatcaccgggctccacagtgacgacgaggc
cgattattactgcgtgaacatgggatagcagcctgaatactggggggtcttcggaactgggaccaaggtcaccgtcctaggttct
agaggtggtggtggtagcggcggcggcggctctggtggtggtggatccctcgagatggccgaggtccagctggtgcagtctg
gagctgaggtgaagaagcctggggcctcagtgaaggtctcctgcaaggcttctggttacacctttaccagctatactatcagctg
ggtacgacaggcccctggacaagggcttgagtggatgggatggatcagcacttacaatggtctcacaaactatgcacagaacct
ccagggcagagtcaccatgactacagacacattcacgaccacagcctacatggagctgaggagcctcagatctgacgacacg
gccgtgtattactgtgtgagagaggggtcccccgactacggtgacttcgcgtcctttgactactggggccagggaaccctggtca
ccgtctcctca [SEQ ID NO: 705]

Amino Acid Sequence
QSVVTQPPSVSAAPGEKVTISCSGSNFNVGNNDVSWYQQLPGAAPKLLIYDNNK
RPSGIPDRFSGSKSGTSATLDITGLHSDDEADYYCGTWDSSLNTGGVFGTGTKVT
VLGSRGGGGSGGGGSGGGGSLEMAEVQLVQSGAEVKKPGASVKVSCKASGYTF
TSYTISWVRQAPGQGLEWMGWISTYNGLTNYAQNLQGRVTMTTDTFTTTAYME
LRSLRSDDTAVYYCVREGSPDYGDFASFDYWGQGTLVTVSS [SEQ ID NO: 706]

TABLE 134

| ET200-108 |
|---|

DNA Sequence
cagtctgtgttgacgcagccgccctcagtgtctgcgccccgggacagaaggtcaccatctcctgctctggaagcagctccaac
attggaataatatgtatcctggtaccagcagttcccaggaacagcccccaaactcctcatttatgacaataataagcgaccctca
gggatttctgaccgattctctggctccaagtctggcacgtcagccaccctgggcatcgccggactccagactggggacgaggc
cgattattactgcgtgaacatgggataccagcctgagtggttttatgtcttcggaagtgggaccaaggtcaccgtcctaggttctag
aggtggtggtggtagcggcggcggcggctctggtggtggtggatccctcgagatggccgaggtccagctggtacagtctgga
gctgaggtgaagaagcctggggcctcagtgaaggtctcctgcaaggcttctggttacacctttaccagctatactatcagctgggt
acgacaggcccctggacaagggcttgagtggatgggatggatcagcacttacaatggtctcacaaactatgcacagaacctcc
agggcagagtcaccatgactacagacacattcacgaccacagcctacatggagctgaggagcctcagatctgacgacacggc
cgtgtattactgtgtgagagaggggtcccccgactacggtgacttcgcgtcctttgactactggggccagggaaccctggtcacc
gtctcctca [SEQ ID NO: 707]

Amino Acid Sequence
QSVLTQPPSVSAPPGQKVTISCSGSSSNIGNNYVSWYQQFPGTAPKLLIYDNNKRP
SGISDRFSGSKSGTSATLGIAGLQTGDEADYYCGTWDTSLSGFYVFGSGTKVTVL
GSRGGGGSGGGGSGGGGSLEMAEVQLVQSGAEVKKPGASVKVSCKASGYTFTS
YTISWVRQAPGQGLEWMGWISTYNGLTNYAQNLQGRVTMTTDTFTTTAYMEL
RSLRSDDTAVYYCVREGSPDYGDFASFDYWGQGTLVTVSS [SEQ ID NO: 708]

TABLE 135

| ET200-109 |
|---|

DNA Sequence
ctgcctgtgctgactcagccaccctcagcgtctgcgaccccgggcagagggtcaccatctcttgttctggaaccacctccaaca
tcggaagtaatactgtacactggtaccagcagctcccagggacggcccccaaactcctcatctataataataatcagcggccctc
aggggtccctgaccgattctctggctccaagtctggcacctcagcctccctggccatcagtgggctccggtccgaggatgaggc
tacatattcctgtgcaacatgggatgacagcctgagtgtggtgttcggcggagggaccaagctgaccgtcctaggttctaga
ggtggtggtggtagcggcggcggcggctctggtggtggtggatccctcgagatggccgaggtccagctggtgcagtctgggg
ctgaggtgaagaagcctgggtcctcggtgaaggtctcctgcaaggcttctggaggcaccttcagcagctatgctatcagctgggt
gcgacaggcccctggacaagggcttgagtggatgggagggatcatccctatctttggtacagcaaactacgcacagaagttcc
agggcagagtcacgattaccgcggacgaatccacgagcacagcctacatggagctgagcagcctgagatctgaggacacgg
ccgtgtattactgtgcgagagatcccgcctacggtgactacgagtatgatgcttttgatatctggggccaagggacaatggtcacc
gtctcttca [SEQ ID NO: 709]

Amino Acid Sequence
LPVLTQPPSASATPGQRVTISCSGTTSNIGSNTVHWYQQLPGTAPKLLIYNNNQRP
SGVPDRFSGSKSGTSASLAISGLRSEDEATYSCATWDDSLSGVVFGGGTKLTVLG
SRGGGGSGGGGSGGGGSLEMAEVQLVQSGAEVKKPGSSVKVSCKASGGTFSSY
AISWVRQAPGQGLEWMGGIIPIFGTANYAQKFQGRVTITADESTSTAYMELSSLR
SEDTAVYYCARDPAYGDYEYDAFDIWGQGTMVTVSS [SEQ ID NO: 710]

TABLE 136

ET200-110

DNA Sequence
cagtctgtgttgacgcagccgccctcagcgtctgggaccccgggcagagggtcaccatctcttgttctggaagcagctccaac
atcggaactaatggtgtaaactggttccagcagttcccaggaacggcccccaaactcctcatctatactaatgatcagcggccctc
agggtccctgaccgattctctggctccaagtctggcacctcagcctccctggccatcagtgggctccagtctgcggatgaggct
gattattactgtgcagtgtgggaccacagcctgaatggtccggtgttcggcggagggaccaagctgaccgtcctaggttctaga
ggtggtggtggtagcggcggcggcggctctggtggtggtggatcccgagatggcccaggtgcagctggtgcagtctgggg
ctgaggtgaagaagcctgggtcctcggtgaaggtctcctgcaaggcttctggaggcacctttcagcagctatgctatcagctggt
gcgacaggcccctggacaagggcttgagtggatgggagggatcatccctatctttggtacagcaaactacgcacagaagttcc
agggcagagtcacgattaccgcggacgaatccacgagcacagcctacatggagctgagcagcctgagatctgaggacacgg
ccgtgtattactgtgcgagaggggccggttttgatgcttttgatatctggggccaagggacaatggtcaccgtctcttca [SEQ
ID NO: 711]

Amino Acid Sequence
QSVLTQPPSASGTPGQRVTISCSGSSSNIGTNGVNWFQQFPGTAPKLLIYTNDQRP
SGVPDRFSGSKSGTSASLAISGLQSADEADYYCAVWDHSLNGPVFGGGTKLTVL
GSRGGGGSGGGGSGGGGSLEMAQVQLVQSGAEVKKPGSSVKVSCKASGGTFSS
YAISWVRQAPGQGLEWMGGIIPIFGTANYAQKFQGRVTITADESTSTAYMELSSL
RSEDTAVYYCARGAGFDAFDIWGQGTMVTVSS [SEQ ID NO: 712]

TABLE 137

ET200-111

DNA Sequence
caggctgtgctgactcagccaccctcagcgtctgggaccccgggcagagggtcaccatctcttgttctggaagcagctccaac
atcggaagtaatactgtaaactggtaccagcagctcccaggaacggcccccaaactcctcatctatagtaataatcagcggccct
caggggtccctgaccgattctctggctccaagtctggcacctcagcctccctggccatcagtgggctccagtctgaggatgaga
ctgattattactgtgcagcatgggatgacagcctgaatggttatgtcttcggaactgggaccaaggtcaccgtcctaggttctaga
ggtggtggtggtagcggcggcggcggctctggtggtggtggatcccgagatggcccaggtgcagctacagcagtggggc
gcaggactgttgaagccttcggagaccctgtccctcacctgcgctgtctatggtgggtccttcagtggttactactggagctggat
ccgccagcccccagggaaggggctggagtggattgggaaatcaatcatagtggaagcaccaactacaacccgtccctcaag
agtcgagtcaccatatcagtagacacgtccaagaaccagttctccctgaagctgagctctgtgaccgccgcggacacggctgtg
tattactgtgcgagagagggctagatgcttttgatatctggggccaagggacaatggtcaccgtctcttca [SEQ ID NO:
713]

Amino Acid Sequence
QAVLTQPPSASGTPGQRVTISCSGSSSNIGSNTVNWYQQLPGTAPKLLIYSNNQRP
SGVPDRFSGSKSGTSASLAISGLQSEDETDYYCAAWDDSLNGYVFGTGTKVTVL
GSRGGGGSGGGGSGGGGSLEMAQVQLQQWGAGLLKPSETLSLTCAVYGGSFSG
YYWSWIRQPPGKGLEWIGEINHSGSTNYNPSLKSRVTISVDTSKNQFSLKLSSVT
AADTAVYYCAREGLDAFDIWGQGTMVTVSS [SEQ ID NO: 714]

TABLE 138

ET200-112

DNA Sequence
caggctgtgctgactcagccaccctcagcgtctgggaccccgggcagagggtcaccatctcttgttctggaagcagctccaac
atcggaagtaatactgtaaactggtaccagcagctcccaggaacggcccccaaactcctcatgtatagtaatgatcagcggccct
caggggtccctgaccgattctctggctccaagtctggcacctcagcctccctggccatcagtgggctccagtctgaggatgagg
ctgattattattgtgcagcatgggatgacagcctgaatggttatgtcttcgcagctgggaccagctcaccgttttaagttctagagg
tggtggtggtagcggcggcggcggctctggtggtggtggatcccgagatggcccaggtgcagctacagcagtggggcgc
aggactgttgaagccttcggagaccctgtccctcacctgcgctgtctatggtgggtccttcagtggttactactggagctggatcc
gccagcccccagggaaggggctggagtggattgggaaatcaatcatagtggaagcaccaactacaacccgtccctcaagag
tcgagtcaccatatcagtagacacgtccaagaaccagttctccctgaagctgagctctgtgaccgccgcggacacggctgtgtat
tactgtgcgagagagggctagatgcttttgatatctggggccaagggacaatggtcaccgtctcttca [SEQ ID NO:
715]

Amino Acid Sequence
QAVLTQPPSASGTPGQRVTISCSGSSSNIGSNTVNWYQQLPGTAPKLLMYSNDQR
PSGVPDRFSGSKSGTSASLAISGLQSEDEADYYCAAWDDSLNGYVFAAGTQLTV
LSSRGGGGSGGGGSGGGGSLEMAQVQLQQWGAGLLKPSETLSLTCAVYGGSFS
GYYWSWIRQPPGKGLEWIGEINHSGSTNYNPSLKSRVTISVDTSKNQFSLKLSSV
TAADTAVYYCAREGLDAFDIWGQGTMVTVSS [SEQ ID NO: 716]

TABLE 139

ET200-113

DNA Sequence
cagtctgtcgtgacgcagccgccctcagtgtctgcggccccaggacagaaggtcaccatctcctgctctggaagcagctccaa
cattgggaataattatgtatcctggtaccagcagctcccaggaacagccccccaaactcctcatttatgacaataataagcgaccct
cagggattcctgaccgattctctggctccaagtctggcacgtcagccaccctgggcatcactggactccagactggggacgag
gccgattattactgcgaacatgggatagcagcctgagtgctgcttatgtcttcggaactgggaccaaggtcaccgtcctaggttc
tagaggtggtggtggtagcggcggcggcggctctggtggtggtggatccctcgagatggcccaggtccagctggtacagtctg
gagctgaggtgaagaagcctggggcctcagtgaaggtctcctgcaaggcttctggttacagctttaccagctatactatcagctg
ggttcgacaggcccctggacaaggccttgagtggatgggatgggtcagcacttacaatggtctcagaaactatgcacagaacct
ccagggcagagtcaccatgactacagacacactcacgaccacagcctacatggagctgaggagcctcagatctgacgacacg
gccgtgtattattgtgtgagagaggggtcccccgactacggtgacttcgcggcctttgactactggggccagggcaccctggtc
accgtctcctca [SEQ ID NO: 717]

Amino Acid Sequence
QSVVTQPPSVSAAPGQKVTISCSGSSSNIGNNYVSWYQQLPGTAPKLLIYDNNKR
PSGIPDRFSGSKSGTSATLGITGLQTGDEADYYCGTWDSSLSAAYVFGTGTKVTV
LGSRGGGGSGGGGSGGGGSLEMAQVQLVQSGAEVKKPGASVKVSCKASGYSFT
SYTISWVRQAPGQGLEWMGWVSTYNGLRNYAQNLQGRVTMTTDTLTTTAYME
LRSLRSDDTAVYYCVREGSPDYGDFAAFDYWGQGTLVTVSS [SEQ ID NO: 718]

TABLE 140

ET200-114

DNA Sequence
caggctgtgctgactcagccaccctcagcgtctgagaccccgggcagagggtcaccatctcttgttctggaagcaggtccaac
atcggaactaatattgtacactggtaccagcagcgcccaggaatggctcctcacttatggtagtcggcggccctca
ggggtcccggaccgattctctggctccaagtttggcacctcagcctccctggccatcagtgggctccagtctgaggatgaggct
gattattattgtgcagcatgggatgacagtctgaatggtccggctttcggcggagggaccaagctgaccgtcctaggttctagag
gtggtggtggtagcggcggcggcggctctggtggtggtggatccctcgagatggcccaggtcagctacagcagtggggcg
caggactgttgaagccttcggagaccctgtccctcacctgcgctgtctatggtgggtccttcagtggttactactggagctggatc
cgccagcccccagggaagggactggagtggattgggaaatcaatcatagtggaagcaccaactacaacccgtccctcaaga
gtcgagtcaccatatcagtagacacgtccaagaaccagttctccctgaagctgagctctgtgaccgccgcggacacggctgtgt
attactgtgcgagagacggtgggggctactttgactactggggccagggaaccctggtcaccgtctcctca [SEQ ID NO: 719]

Amino Acid Sequence
QAVLTQPPSASETPGQRVTISCSGSRSNIGTNIVHWYQQRPGMAPKLLTYGSRRP
SGVPDRFSGSKFGTSASLAISGLQSEDEADYYCAAWDDSLNGPAFGGGTKLTVL
GSRGGGGSGGGSGGGGSLEMAQVQLQQWGAGLLKPSETLSLTCAVYGGSFSG
YYWSWIRQPPGKGLEWIGEINHSGSTNYNPSLKSRVTISVDTSKNQFSLKLSSVT
AADTAVYYCARDGGGYFDYWGQGTLVTVSS [SEQ ID NO: 720]

TABLE 141

ET200-115

DNA Sequence
cagtctgtgttgacgcagccgccctcagtgtctggggccccagggcagagggtcaccatctcctgcactgggagcagctccaa
tatcggggcacgttatgatgtacactggtaccagcaactcccaggaacagccccccgactcctcatctctgctaactacgatcgg
ccctcaggggtccctgaccgattctctggctccaagtctggcacctcagcctccctggccatcactgggctccaggctgaggat
gaggctgattattactgccagtcctatgacagcagtgtgagtgcttgggtgttcggcggagggaccaaggtcaccgtcctaggtt
ctagaggtggtggtggtagcggcggcggcggctctggtggtggtggatccctcgagatggccgaagtgcagctggtgcagtct
ggggctgaagtgaaggagcctggggcctcagtgaggatctcctgcaggcatctggatacaacttcatcagttattatatgcact
gggtgcggcaggcccctgggcaaggtcttgagtggatgggcaccatcaacccaggcagtggtgagacagactactcacaga
agttcagggcagagtcaccatgaccagggaccccgtccacgggtacattcgacatggggctgagcagcctgacatctgggga
cacggccgtctattattgcgacaggtctcatcagaggagctagcgatgcttttaatatctgggccggggggacaatggtcacc
gtctcttca [SEQ ID NO: 721]

Amino Acid Sequence
QSVLTQPPSVSGAPGQRVTISCTGSSSNIGARYDVHWYQQLPGTAPRLLISANYD
RPSGVPDRFSGSKSGTSASLAITGLQAEDEADYYCQSYDSSVSAWVFGGGTKVT
VLGSRGGGGSGGGGSGGGGSLEMAEVQLVQSGAEVKEPGASVRISCQASGYNFI
SYYMHWVRQAPGQGLEWMGTINPGSGETDYSQKLQGRVTMTRDPSTGTFDMG
LSSLTSGDTAVYYCATGLIRGASDAFNIWGRGTMVTVSS [SEQ ID NO: 722]

TABLE 142

ET200-116

DNA Sequence
cagcctgtgctgactcagccaccctcagtgtccgtgtccccaggacagacggccgccatcccctgttctggagataagttgggg
gataaatttgcttcctggtatcagcagaagccaggccagtcccctgtgctggtcatctatcaagatactaagcggccctcagggat
ccctgagcgattctctggctccaactctgggaacacagccactctgaccatcagcgggacccaggctatggatgaggctgacta
ttactgtcagacgtgggccagcggcattgtggtgttcggcggagggaccaagctgaccgtcctaggttctagaggtggtggtgg
tagcggcggcggcggctctggtggtggtggatccctcgagatggcccaggtacagctgcagcagtcaggtccaggactggtg
aagccctcgcagaccctctcactcacctgtgccatctccggggacagtgtctctagcaacagtgctgcttggaactggatcaggc
agtccccatcgagaggccttgagtggctgggaaggacatactacaggtccaagtggtataatgattatgcagtatctgtgaaaag
tcgaataaccatcaacccagacacatccaagaaccagttctccctgcagctgaactctgtgactcccgaggacacggctgtgtat
tactgtgcaagagagcgcagtggctggaagggatttgactactggggccagggaaccctggtcaccgtctcctca [SEQ ID
NO: 723]

Amino Acid Sequence
QPVLTQPPSVSVSPGQTAAIPCSGDKLGDKFASWYQQKPGQSPVLVIYQDTKRPS
GIPERFSGSNSGNTATLTISGTQAMDEADYYCQTWASGIVVFGGGTKLTVLGSRG
GGGSGGGGSGGGGSLEMAQVQLQQSGPGLVKPSQTLSLTCAISGDSVSSNSAAW
NWIRQSPSRGLEWLGRTYYRSKWYNDYAVSVKSRITINPDTSKNQFSLQLNSVTP
EDTAVYYCARERSGWKGFDYWGQGTLVTVSS [SEQ ID NO: 724]

TABLE 143

ET200-117

DNA Sequence
gatgttgtgatgactcagtctccaccctcctgtccgtcacccctggagagccggcctccatcacctgcaggtctagtcagagcct
cctggaaagaaatgcatacaacttggattggtacctgcagaggccaggacagtctccacagctcctgatctacttgggttcta
atcgggccgccggggtccctgacaggttcagtggcagtggatcaggcagagattttacactgaaaatcagcagagtggagcct
gaggatgttggggtttattactgcatgcaagctcaagctccgttcactttcggcggagggaccaaggtggagatcaaacgttc
tagaggtggtggtggtagcggcggcggcggctctggtggtggtggatccctcgagatggccgaagtgcagctggtgcagtct
gggggaggcttggtacagcctggggggtccctgagactctcctgtgcagcctctggattcacctttagcagctatgccatgagct
gggtccgccaggctccagggaaggggctggagtgggtctcagctattagtggtagtggtagcacatactacgcagactcc
gtgaagggccggttcaccatctccagagacaattccaagaacacgctgtatctgcaaatgaacagcctgagagccgaggacac
ggccgtatattactgtgcgaaatgggcccgtttcaggatgcttttgatatctggggccaagggacaatggtcaccgtctcttca
[SEQ ID NO: 725]

Amino Acid Sequence
DVVMTQSPPSLSVTPGEPASITCRSSQSLLERNAYNYLDWYLQRPGQSPQLLIYL
GSNRAAGVPDRFSGSGSGRDFTLKISRVEPEDVGVYYCMQALQAPFTFGGGTKV
EIKRSRGGGSGGGGSGGGGSLEMAEVQLVQSGGGLVQPGGSLRLSCAASGFTF
SSYAMSWVRQAPGKGLEWVSAISGSGGSTYYADSVKGRFTISRDNSKNTLYLQ
MNSLRAEDTAVYYCAKWGPFQDAFDIWGQGTMVTVSS [SEQ ID NO: 726]

TABLE 144

ET200-118

DNA Sequence
caggctgtgctgactcagcctgcctccgtgtctgggtctcctggacagtcgatcaccatctcctgcactggaaccagcagtgacg
ttggtggttataactatgtctcctggtaccaacagcacccgggcaaagcccccaaactcatgatttatgaggtcagtaatcggccc
tcaggggtttctaatcgcttctctggctccaagtctggcaacacggcctccctgaccatctctgggctccaggctgaggacgagg
ctgattattactgcagctcatatacaagcagcagcacccttatgtcttcggagcagggaccaaggtcaccgtcctaggttctaga
ggtggtggtggtagcggcggcggcggctctggtggtggtggatccctcgagatggccgaggtgcagctggtggagtctggg
gaggcttggtacagcctggcaggtccctgagactctcctgtgcagcctctggattcacctttgatgattatgccatgcactgggtcc
ggcaagctccagggaagggcctggagtgggtctcaggtattagttggaatagtggtagcataggctatgcggactctgtgaagg
gccgattcaccatctccagagacaacgccaagaaccctgtatctgcaaatgaacagtctgagagctgaggacacggccttgt
attactgtgcaaaagccaggtggacagtggcatcagaccaccactttgactactggggccagggaacgctggtcaccgtct
cctca [SEQ ID NO: 727]

Amino Acid Sequence
QAVLTQPASVSGSPGQSITISCTGTSSDVGGYNYVSWYQQHPGKAPKLMIYEVSN
RPSGVSNRFSGSKSGNTASLTISGLQAEDEADYYCSSYTSSSTPYVFGAGTKVTV
LGSRGGGGSGGGGSGGGGSLEMAEVQLVESGGGLVQPGRSLRLSCAASGFTFD
DYAMHWVRQAPGKGLEWVSGISWNSGSIGYADSVKGRFTISRDNAKNSLYLQM
NSLRAEDTALYYCAKARWTAVASDHHFDYWGQGTLVTVSS [SEQ ID NO: 728]

TABLE 145

ET200-119

DNA Sequence
caggctgtgcttactcagccaccctcagcgtctgggaccccgggcagagggtcaccatctcttgttctggaagcagctccaac
atcggaagtaatactgtaaactggtaccagcagctcccaggaacggccccccaaactcctcatctatagtaataatcagcggccct
caggggtccctgaccgattctctggctccaagtctggcacctcagctcccctggccatcagtgggctccagtctgaggatgagg
ctgattattactgtgcagcatgggatgacagcctgaatggttatgtcttcggaactgggaccaagctgaccgtcctaggttctaga
ggtggtggtggtagcggcggcggcggctctggtggtggtggatccctcgagatggccgaggtgcagctggtgcagtctgggg
ctgaggtgaagaagcctgggtcctcggtgaaggtctcctgcaaggcttctggaggcacctcagcagctatgctatcagctgggt
gcgacaggcccctggacaagggcttgagtggatgggagggatcatccctatctttggtacagcaaactacgcacagaagttcc
agggcagagtcacgattaccgcggacgaatccacgagcacagcctacatggagctgagcagcctgagatctgaggacacgg
ccgtgtattactgtgcgagagattgggactacatggacgtctggggcaaagggaccacggtcaccgtctcctca [SEQ ID NO: 729]

Amino Acid Sequence
QAVLTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYVFGTGTKLTVL
GSRGGGGSGGGGSGGGGSLEMAEVQLVQSGAEVKKPGSSVKVSCKASGGTFSS
YAISWVRQAPGQGLEWMGGIIPIFGTANYAQKFQGRVTITADESTSTAYMELSSL
RSEDTAVYYCARDWDYMDVWGKGTTVTVSS [SEQ ID NO: 730]

TABLE 146

ET200-120

DNA Sequence
tcctatgagctgactcagccaccctcagcgtctgggaccccgggcagagggtcaccatctcttgttctggaagcagctccaac
atcggaagtaatactgtaaactggtaccagcagctcccaggaacggccccccaaactcctcatctatagtaataatcagcggccct
caggggtccctgaccgattctctggctccaagtctggcacctcagctcccctggccatcagtgggctccagtctgaggatgagg
ctgattattactgtgcagcatgggatgacagcctgaatggttatgtcttcggaactgggaccaaggtcaccgtcctaggttctaga
ggtggtggtggtagcggcggcggcggctctggtggtggtggatccctcgagatggccgaggtgcagctggtggagtctggag
ctgaggtgaagaagcctggggcctcagtgaaggtctcctgcaaggcttctggttacacctttaccagctatggtatcagctgggt
gcgacaggcccctggacaagggcttgagtggatgggatggattacaatggtaacacaaactatgcacagaagctcc
agggcagagtcaccatgaccacagacacatccacgagcacagcctacatggagctgaggagcctgagatctgacgacacgg
ccgtgtattactgtgcgagagacctatctcggggagctaacccgcattactactactactacggtatggacgtctggggccaagg
gaccacggtcaccgtctcctca [SEQ ID NO: 731]

Amino Acid Sequence
SYELTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYVFGTGTKVTVL
GSRGGGGSGGGGSGGGGSLEMAEVQLVESGAEVKKPGASVKVSCKASGYTFTS
YGISWVRQAPGQGLEWMGWISAYNGNTNYAQKLQGRVTMTTDTSTAYMEL
RSLRSDDTAVYYCARDLSRGANPHYYYYYGMDVWGQGTTVTVSS [SEQ ID NO: 732]

TABLE 147

ET200-121

DNA Sequence
cagtctgtgttgacgcagccgccctcagtgtctggggccccagggcagagggtcaccgtctcctgcactgggagcagatccaa
catcggggcaggatatgatgtacactggtaccagcaacttcaggaacggcccccaaactcctcatctatggaaatagtaatcgg
cctccaggggtccctgaccgattctctgggtctaagtctggcacctcagcctccctggtcatcactgggctccaggctgaggatg
ccgctgattattactgccagtcctatgacaacactgtgcgtaatcaccttatgtcttcggaactgggaccaaggtcaccgtcctag
gttctagaggtggtggtggtagcggcggcggcggctctggtggtggtggatccctcgagatggccgaggtccagctggtacag
tctggggctgaggtgaagaagcctggggcctcagtgaaggtctcctgcaaggtttccggatacaccctcactgaattatccatgc
actgggtgcgacaggcctcctggaaaagggcttgagtggatgggagggtttttgatcctgaagatggtgaaacaatctacgcacaga
agttccagggcagagtcaccatgaccgaggacacatctacagacacagcctacatggagctgagcagcctgagatctgagga
cacggccgtgtattactgtgcaacagagagtaatttagtgtcccggcactactactactacggtatggacgtctggggccaaggg
accacggtcaccgtctcctca [SEQ ID NO: 733]

Amino Acid Sequence
QSVLTQPPSVSGAPGQRVTVSCTGSRSNIGAGYDVHWYQQLPGTAPKLLIYGNS
NRPPGVPDRFSGSKSGTSASLVITGLQAEDAADYYCQSYDNTVRESPYVFGTGTK
VTVLGSRGGGGSGGGGSGGGGSLEMAEVQLVQSGAEVKKPGASVKVSCKVSG
YTLTELSMHWVRQAPGKGLEWMGGFDPEDGETIYAQKFQGRVTMTEDTSTDTA
YMELSSLRSEDTAVYYCATESNLVSRHYYYYGMDVWGQGTTVTVSS [SEQ ID NO: 734]

TABLE 148

ET200-122

DNA Sequence
ctgcctgtgctgactcagccaccctcagcgtctgggaccccgggcagagggtcaccatctcttgttctggaaccagctccaac
atcggaagtaattctgtagactggtaccagcagctcccaggaacggccccaaactcctcatctatagtaataatcagcggccct
caggggtccctgaccgaatctctggctccaagtctggcacctcagcctccctggccatcagtgggctccagtctgaggatgagg
ctgattattactgtgcagcatgggatgacagcctgaatggttatgtcttcggaactgggaccaaggtcaccgtcctaggttctaga
ggtggtggtggtagcggcggcggcggctctggtggtggtggatccctcgagatggccgaagtgcagctggtgcagtctgggg
ctgaggtgaagaagcctggggcctcagtgaaggtctcctgcaaggcttctggatacaccttcaccggctactatatgcactgggt
gcgacaggcccctggacaagggcttgagtggatgggatggatcaaccctaacagtggtggcacaaactatgcacagaagtttc
agggcagggtcaccatgaccagggacacgtccatcagcacagcctacatggagctgagcaggctgagatctgacgacacgg
ccgtgtattactgtgcgagagattacggatactatggttcggggagttattcgagcggcccccctttactactactacggtatggacg
tctggggccaagggaccacggtcaccgtctcctca [SEQ ID NO: 735]

Amino Acid Sequence
LPVLTQPPSASGTPGQRVTISCSGTSSNIGSNSVDWYQQLPGTAPKLLIYSNNQRP
SGVPDRISGSKSGTSASLAISGLQSEDEADYYCAAWDDSLNGYVFGTGTKVTVL
GSRGGGGSGGGGSGGGGSLEMAEVQLVQSGAEVKKPGASVKVSCKASGYTFTG
YYMHWVRQAPGQGLEWMGWINPNSGGTNYAQKFQGRVTMTRDTSISTAYMEL
SRLRSDDTAVYYCARDYGYYGSGSYSSGPLYYYYGMDVWGQGTTVTVSS [SEQ
ID NO: 736]

TABLE 149

ET200-123

DNA Sequence
caggctgtgctgactcagccaccctcagcgtctgggaccccgggcagagggtcaccatctcttgttctggaagcagctccaac
atcggaagtaatactgtaaactggtaccagcagctcccaggaacggccccaaactcctcatgtataataatgatcagcggccct
caggggtccctgaccgattctctggctccaagtctggcacctcagcctccctggccatcagtgggctccagtctgaggatgagg
ctgattattactgtgcagcatgggatgacagcctcaatggttatgtcttcggacctgggaccaaggtcaccgtcctaggttctagag
gtggtggtggtagcggcggcggcggctctggtggtggtggatccctcgagatggccaggtgcagctggtggagtctggagc
tgaggtgaagaagcctggggcctcagtgaaggtctcctgcaaggcttctggttacacctttaccagctatggtatcagctgggtg
cgacaggcccctggacaagggcttgagtggatgggatggatcagcgcttacaatggtaacacaaactatgcacagaagctcca
gggcagagtcaccatgaccacagacacatccacgagcacagcctacatggagctgaggagcctgagatctgacgacacggc
cgtgtattactgtgcgagagacctatctcggggagctaacccgcattactactactactacggtatggacgtctggggccaaggg
accacggtcaccgtctcctca [SEQ ID NO: 737]

Amino Acid Sequence
QAVLTQPPSASGTPGQRVTISCSGSSSNIGSNTVNWYQQLPGTAPKLLMYNNDQ
RPSGVPDRFSGSKSGTSASLAISGLQSEDEADYYCAAWDDSLNGYVFGPGTKVT
VLGSRGGGGSGGGGSGGGGSLEMAQVQLVESGAEVKKPGASVKVSCKASGYTF
TSYGISWVRQAPGQGLEWMGWISAYNGNTNYAQKLQGRVTMTTDTSTSTAYM
ELRSLRSDDTAVYYCARDLSRGANPHYYYYYGMDVWGQGTTVTVSS [SEQ ID
NO: 738]

TABLE 150

ET200-125

DNA Sequence
aattttatgctgactcagccccacgctgtgtcggagtctccggggaagacggtaaccatctcctgcacccgcagcagtggcagt
attgccagcaactatgtgcagtggtaccagcagcgcccgggcagttcccccgcactgtgatttatgaggataatcaaagaccct
ctgggggtccctggtcggttctctggctccatcgacagctcctccaactctgcctccctcaccatctctggactgaagactgaggac
gaggctgactactactgtcagtcttatgattccaccagtgtgcttttcggcggagggaccaagctgaccgtcctaggttctagagg
tggtggtggtagcggcggcggcggctctggtggtggtggatccctcgagatggccgaggtgcagctggtgcagtctggggct
gaggtgaagaagccagggtcctcggtgaaggtctcctgcaaggctcgggaggcaccttcagcagcaattctctcagctgggt
gcgacaggcccctggacaagggcttgagtggatgggaaggatcttccctatcctgggtataacaaactatgcacagaagttcca
gggcagagtcacgattaccgcggacaaatccacgagcacagcctacatggagctgagcagcctgagatctgaggacacggc
cgtctattactgtgcgagaggaaactaccaatggtatgatgcttttgatatctggggccaagggacaatggtcaccgtctcttca
[SEQ ID NO: 739]

Amino Acid Sequence
NFMLTQPHAVSESPGKTVTISCTRSSGSIASNYVQWYQQRPGSSPRTVIYEDNQR
PSGVPGRFSGSIDSSSNSASLTISGLKTEDEADYYCQSYDSTSVLFGGGTKLTVLG
SRGGGGSGGGGSGGGGSLEMAEVQLVQSGAEVKKPGSSVKVSCKASGGTFSSN
SLSWVRQAPGQGLEWMGRIFPILGITNYAQKFQGRVTITADKSTSTAYMELSSLR
SEDTAVYYCARGNYQWYDAFDIWGQGTMVTVSS [SEQ ID NO: 740]

TABLE 151

ET200-005

DNA Sequence
cagcctgtgctgactcagccaccctcagtgtcagtggtcccaggaaagacggccaggattacctgtgggggaaaaaacattgg
aagtaaaagtgtgcactggtaccagcagaagccaggcccctgtggtggtcatccattatgatagtgaccggccctcag
ggatccctgagcgattctctggctccaactctgggaacacggccaccctgaccatcagcagggtcgaagccggggatgaggc
cgactattactgtcaggtgtgggatagtagtagtgatcatccttatgtcttcggaactgggaccaaggtcaccgtcctaggttctag
aggtggtggtggtagcggcggcggcggctctggtggtggtggatccctcgagatggcccaggtgcagctggtgcagtctgga
gctgaggtgaagaagcctggggcctcagtgaaggtctcctgcaaggcttctggttacacctttaccaactatggtatcagctgggt
gcgacaggcccctggacaagggcttgagtggatgggatggatcagcgcttacaatggtaacacaaactatgcacataagctcc
agggcagagtcaccatgaccacagacacatccacgagcacagccaacatggagctgaggagcctgagacctgacgacactg
ccgtgtattactgtgcgcgctcttacttcggttctcatgattactggggtcaaggtactctggtgaccgtctcctca [SEQ ID NO: 741]

Amino Acid Sequence
QPVLTQPPSVSVVPGKTARITCGGKNIGSKSVHWYQQKPGQAPVVVIHYDSDRP
SGIPERFSGSNSGNTATLTISRVEAGDEADYYCQVWDSSSDHPYVFGTGTKVTVL
GSRGGGGSGGGGSGGGGSLEMAQVQLVQSGAEVKKPGASVKVSCKASGYTFT
NYGISWVRQAPGQGLEWMGWISAYNGNTNYAHKLQGRVTMTTDTSTSTANME
LRSLRPDDTAVYYCARSYFGSHDYWGQGTLVTVSS [SEQ ID NO: 742]

TABLE 152

ET200-124

DNA Sequence
tcctatgtgctgactcagccaccctcggtgtcagtggcccaggaaagacggccaggatttcctgtgggggaaacgacattgga
agtaaaagtgttttcggtatcagcagaggccaggcccaggcccctgtgttggtcgtctatgatgatagcgaccggccctcagggc
tccctgagcgattctctggcttcaactctgggaacacggccaccctgaccatcagcagggtcgaagccggggatgaggccgac
tattactgtcaagtgtgggatagtagtagtgatcattatgtcttcggaactgggaccaaggtcaccgtcctaggttctagaggtggt
ggtggtagcggcggcggcggctctggtggtggtggatccctcgagatggcccaggtgcagctggtggagtctgggggaggc
ttggtacagcctggcaggtccctgagactctcctgtgcagcctctggattcaccttcgatgattatgccatgcactgggtccggcaa
gctccagggaagggcctggagtgggtctcaggtattagttggaatagtggtagcatggcatggcatacctatgcggactctgtgaagggccga
ttcaccatctccagagacaacgccaagaactccctgtatctgcaaatgaacagtctgagagctgaggacacggccttgtattact
gtgcaaaagatataacctatggttcggggagttatggtgcttttgatatctggggccaagggacaatggtcaccgtctcttca
[SEQ ID NO: 743]

Amino Acid Sequence
SYVLTQPPSVSVAPGKTARISCGGNDIGSKSVFWYQQRPGQAPVLVVYDDSDRP
SGLPERFSGFNSGNTATLTISRVEAGDEADYYCQVWDSSSDHYVFGTGTKVTVL
GSRGGGGSGGGGSGGGGSLEMAQVQLVESGGGLVQPGRSLRLSCAASGFTFDD
YAMHWVRQAPGKGLEWVSGISWNSGSIGYADSVKGRFTISRDNAKNSLYLQMN
SLRAEDTALYYCAKDITYGSGSYGAFDIWGQGTMVTVSS [SEQ ID NO: 744]

XII. Exemplary Extracellular Antigen-Binding Domains (e.g., scFvs) Comprising a Heavy Chain Variable Region, a Light Chain Variable Region, a Linker Peptide and a His-tag and HA-tag

TABLE 153

ET200-001

DNA Sequence
cagtctgtgttgacgcagccaccctcagcgtctgggaccccgggcagagggtcaccatctcttgttctggaagcagctccaac
atcggaagtaatactgtaaactggtaccagcagctcccaggaacggccccaaactcctcatctatagtaataatcagcggccct
caggggtccctgaccgattctctggctccaagtctggcacctcagcctccctggccatcagtgggctccagtctgaggatgagg
ctgattattactgtgcagcatgggatgacagcctgaatggttatgtcttcggaactgggaccaaggtcaccgtcctaggttctaga
ggtggtggtggtagcggcggcggcggctctggtggtggtggatccctcgagatggcccaggtgcagctacagcagtgggc
gcaggactgttgaagccttcggagaccctgtccctcacctgcgctgtgtatggtgggtccttcagtggttactactggagctggat
ccgccagcccccagggaaggggctggagtggattgggaaatcaatcatagtggaagcaccaactacaacccgtccctcaag
agtcgagtcaccatatcagtagacacgtccaagaaccagttctccctgaagctgagctctgtgaccgccgcggacacggccgt
gtattactgtgcgcgcgaaggtccgtacgacggtttcgattcttggggtcaaggtactctggtgaccgtctcctcaactagtggcc
aggccggccagcaccatcaccatcaccatggcgcatacccgtacgacgttccggactacgcttct [SEQ ID NO: 745]

Amino Acid Sequence
QSVLTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYVFGTGTKVTVL
GSRGGGGSGGGGSGGGGSLEMAQVQLQQWGAGLLKPSETLSLTCAVYGGSFSG TABLE 153-continued

ET200-001

YYWSWIRQPPGKGLEWIGEINHSGSTNYNPSLKSRVTISVDTSKNQFSLKLSSVT
AADTAVYYCAREGPYDGFDSWGQGTLVTVSSTSGQAGQHHHHHHGAYPYDVP
DYAS [SEQ ID NO: 746]

TABLE 154

ET200-002

DNA Sequence
aattttatgctgactcagcccactctgtgtcggagtctccggggaagacggtaaccatctcctgcacccgcagcagtggcagca
ttgccagcaactatgtgcagtggtaccagcagcgccccggcagtgcccccaccactgtgatctatgaggataaccaaagaccct
ctggggtccctgatcggttctctggctccatcgacagctcctccaactctgcctccctcaccatctctggactgaagactgaggac
gaggctgactactactgtcagtcttatgatagcagcaattctgtggtattcggcggagggaccaagctgaccgtcctaggttctag
aggtggtggtggtagcggcggcggcggctctggtggtggtggatccctcgagatggcccaggtccagctggtacagtctggc
actgaggtgaagaagcctggggcctcagtgagggtcgcctgcaaggcttctggttacccctttaacaaatatgacatcaactggg
tgcgacaggcccctggacaagggcttgagtggatgggaggcatcatccctatctttcgtacaacaaactacgcacagaagttcc
agggcagagtcacgattaccgcggacgaatccacgagcacagcctacatggagctgagcagcctgagatctgaggacacgg
ccgtatattactgtgcgcgcgaatggttctactgggatatctggggtcaaggtactctggtgaccgtctcctcaactagtggccag
gccggccagcaccatcaccatcaccatggcgcatacccgtacgacgttccggactacgcttct [SEQ ID NO: 747]

Amino Acid Sequence
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSSNSVVFGGGTKLTVLG
SRGGGGSGGGGSGGGGSLEMAQVQLVQSGTEVKKPGASVRVACKASGYPFNK
YDINWVRQAPGQGLEWMGGIIPIFRTTNYAQKFQGRVTITADESTSTAYMELSSL
RSEDTAVYYCAREWFYWDIWGQGTLVTVSSTSGQAGQHHHHHHGAYPYDVPD
YAS [SEQ ID NO: 748]

TABLE 155

ET200-003

DNA Sequence
cagtctgtgttgactcagccaccctcagtgtccgtgtccccaggacagacagccagcatctcctgctctggaaataaattgggga
ctaagtatgttttactggtatcagaagaggccaggccagtcccctgtgttggtcatgtatgaagataatcagcggccctcagggatc
ccggagcggttctctggctccaactctgggaacacagccactctgaccatcagagggacccagactgtggatgaggctgactat
tactgtcaggcgtgggactccgacactttcgtggtcttcggcggagggaccaagctcaccgtcctaggttctagaggtggtggtg
gtagcggcggcggcggctctggtggtggtggatccctcgagatggccgaggtgcagctggtggagaccgggggaggcgtg
gtccagcctgggaggtccctgagactctcctgtgcagcctctggattcaccttcagtagttatggcatgcactgggtccgccagg
ctccaggcaaggggctggagtgggtggcagttatatcacatgatggaagtaataaatactacgcagactccgtgaagggccgat
tcaccatctccagagacaattccaaggacacgctgtatctgcaaatgaacagcctgagaggtgaggacacggccgtatattact
gtgcgcgctctaaccagtggtctggttacttctcttcgattactggggtcaaggtactctggtgaccgtctcctcaactagtggcca
ggccggccagcaccatcaccatcaccatggcgcatacccgtacgacgttccggactacgcttct [SEQ ID NO: 749]

Amino Acid Sequence
QSVLTQPPSVSVSPGQTASISCSGNKLGTKYVYWYQKRPGQSPVLVMYEDNQRP
SGIPERFSGSNSGNTATLTIRGTQTVDEADYYCQAWDSDTFVVFGGGTKVTVLG
SRGGGGSGGGGSGGGGSLEMAEVQLVETGGGVVQPGRSLRLSCAASGFTFSSYG
MHWVRQAPGKGLEWVAVISHDGSNKYYADSVKGRFTISRDNSKDTLYLQMNS
LRGEDTAVYYCARSNQWSGYFSFDYWGQGTLVTVSSTSGQAGQHHHHHHGAY
PYDVPDYAS [SEQ ID NO: 750]

TABLE 156

ET200-006

DNA Sequence
tcctatgtgctgactcagccaccctcagtgtcagtggccccaggaaagacggccaggattacctgtgggggaaacaacattgga
agtaaaagtgtgcactggtaccagcagaagccaggccaggcccctgtggtggtcatccattatgatagcgaccggccctcagg
gatccctgagcgattctctggctccaactctgggaacacggccaccctgaccatcagcagggtcgaagccggggatgaggcc
gactattactgtcaggcgtgggatagtagtagtgatcatcctatgtcttcggaactgggaccaagctcaccgtcctaggttctaga
ggtggtggtggtagcggcggcggcggctctggtggtggtggatccctcgagatggccgaggtgcagctggtgcagtctggag
ctgaggtgaagaagcctggggcctcagtgaaggtctcctgcaaggcttctggttacacctttaccacctatggtatcagctgggtg
cgacaggcccctggacaagggcttgagtggatgggatggatcaacacttacaatggtcacacaaactatgcacagaagctcca
gggcagagccacaatgaccgcagacacatccacgaacacagcctacatggagctgaggagcctgagatctgacgacactgc TABLE 156-continued

ET200-006 cgtgtattactgtgcgcgcgttatctacggttctggtgattactggggtcaaggtactctggtgaccgtctcctcaactagtggcca
ggccggccagcaccatcaccatcaccatggcgcatacccgtacgacgttccggactacgcttct [SEQ ID NO: 751]

Amino Acid Sequence
SYVLTQPPSVSVAPGKTARITCGGNNIGSKSVHWYQQKPGQAPVVVIHYDSDRP
SGIPERFSGSNSGNTATLTISRVEAGDEADYYCQVWDSSSDHPYVFGTGTKVTVL
GSRGGGGSGGGGSGGGGSLEMAEVQLVQSGAEVKKPGASVKVSCKASGYTFTT
YGISWVRQAPGQGLEWMGWINTYNGHTNYAQKLQGRATMTADTSTNTAYMEL
RSLRSDDTAVYYCARVIYGSGDYWGQGTLVTVSSTSGQAGQHHHHHHGAYPY
DVPDYAS [SEQ ID NO: 752]

TABLE 157

ET200-007

DNA Sequence
tcctatgtgctgactcagccactctcagtgtcagtggccccaggaaagacggccaggattacctgtgggggaaacaacattgga
agtaaaactgtgcactggtaccagcagaagccaggccaggcccctgtgctggtcatctattatgatagcgaccggccctcaggg
atccctgagcgattctctggctccaactctgggaacacggccaccctgaccatcagcagggtcgaagccggggatgaggcc
actattactgtcaggtgtgggatagtagtagtgatcatccggtgttcggcggagggaccaagctgaccgtcctaggttctagagg
tggtggtggtagcggcggcggcggctctggtggtggtggatccctcgagatggcccaggtgcagctgcaggagtcgggccc
aggactggtgaagccttcggagaccctgtccctcacctgcaatgtctctggttactccatcagcagtggttactttggggctggat
ccggcagcccccagggaaggggctggagtggattgggagtatctatcatagtaggagcacctactacaacccgtccctcaaga
gtcgagtcaccatatcagtagacacgtccaagaaccagttctccctgaagctgaactctgtgaccgccgcagacacggccgtgt
attactgtgcgcgcggttacggttacttcgattactggggtcaaggtactctggtgaccgtctcctcaactagtggccaggccggc
cagcaccatcaccatcaccatggcgcatacccgtacgacgttccggactacgcttct [SEQ ID NO: 753]

Amino Acid Sequence
SYVLTQPLSVSVAPGKTARITCGGNNIGSKTVHWYQQKPGQAPVLVIYYDSDRP
SGIPERFSGSNSGNTATLTISRVEAGDEADYYCQVWDSSSDHRVFGGGTKLTVLG
SRGGGGSGGGGSGGGGSLEMAQVQLQESGPGLVKPSETLSLTCNVSGYSISSGYF
WGWIRQPPGKGLEWIGSIYHSRSTYYNPSLKSRVTISVDTSKNQFSLKLNSVTAA
DTAVYYCARGYGYFDYWGQGTLVTVSSTSGQAGQHHHHHHGAYPYDVPDYAS
[SEQ ID NO: 754]

TABLE 158

ET200-008

DNA Sequence
caatctgccctgactcagcctgcctccgtgtctgggtctcctggacagtcgatcaccatctcctgcactggaaccagcagtgacgt
tggtggttataactatgtctcctggtaccaacaacacccaggcaaagcccccaaactcatgatttatgatgtcagtaatcggccctc
aggggtttctaatcgcttctctggctccaagtctggcaacacggcctccctgaccatctctgggctccaggctgaggacgaggct
gattattactgcagctcatatacaagcagcagcacttcgaaggtgttcggcggagggaccaagctgaccgtcctaggttctagag
gtggtggtggtagcggcggcggcggctctggtggtggtggatccctcgagatggccgaggtgcagctggtggagtctggggg
aggtgtggtacggcctgggggtccctgagactctcctgtgcagcctctggattcacctttggtgattatgccatgagctgggtccg
gccaagctccagggaaggggctggagtgggtctctggtattaattggaatggtggtagcacaggttatgcagactctgtgaagg
gccgattcaccatctccagagacaacgccaagaactccctgtatctgcaaatgaacagtctgagagccgaggacacggccgta
tattactgtgcgcgctctaaatacaacttccatgtttactacgattactggggtcaaggtactctggtgaccgtctcctcaactagtgg
ccaggccggccagcaccatcaccatcaccatggcgcatacccgtacgacgttccggactacgcttct [SEQ ID NO:
755]

Amino Acid Sequence
QSALTQPASVSGSPGQSITISCTGTSSDVGGYNYVSWYQQHPGKAPKLMIYDVSN
RPSGVSNRFSGSKSGNTASLTISGLQAEDEADYYCSSYTSSSTSKVFGGGTKLTVL
GSRGGGGSGGGGSGGGGSLEMAEVQLVESGGGVVRPGGSLRLSCAASGFTFGD
YGMSWVRQAPGKGLEWVSGINWNGGSTGYADSVKGRFTISRDNAKNSLYLQM
NSLRAEDTAVYYCARSKYNFHVYYDYWGQGTLVTVSSTSGQAGQHHHHHHGA
YPYDVPDYAS [SEQ ID NO: 756]

TABLE 159

ET200-009

DNA Sequence
cagtctgtgttgacgcagccaccctcagcgtctgggaccccgggcagacagtcaccatctcttgttctggaagcaactccaac
atcggaagtaattatgtatactggtaccagcagctcccaggacggccccaaactcctcatctataggaataatcagcggccct
caggggtccctgaccgattctcaggctccaagtctggcacctcagcctcctggccatcagtgggctccgctccgaggatgag
gctgattattactgtgcagcatgggatgacagcctgagtgcttatgtcttcggaactgggaccaaggtcaccgtcctaggttctag
aggtggtggtggtagcggcggcggcggctctggtggtggtggatccctcgagatggcccaggtgcagctggtgcagtctgga
gctgaggtgaagaagcctggggcctcagtgaaggtctcctgcaaggcttctggttacacctttaccagctatggtatcagctggg
tgcgacaggcccctggacaagggcttgagtggatgggatggatcagcgcttacaatggtaacacaaactatgcacagaagctc
cagggcagagtcaccatgaccacagacacatccacgagcacagcctacatggagctgaggagcctgagatctgacgacactg
ccgtgtattactgtgcgcgctcttctggtaacatggtttcttggaaagatatgtggggtcaaggtactctggtgaccgtctcctcaac
tagtggccaggccgccagcaccatcaccatcaccatggcgcatacccgtacgacgttccggactacgcttct [SEQ ID
NO: 757]

Amino Acid Sequence
QSVLTQPPSASGTPGQTVTISCSGSNSNIGSNYVYWYQQLPGTAPKLLIYRNNQR
PSGVPDRFSGSKSGTSASLAISGLRSEDEADYYCAAWDDSLSAYVFGTGTKVTVL
GSRGGGGSGGGGSGGGGSLEMAQVQLVQSGAEVKKPGASVKVSCKASGYTFTS
YGISWVRQAPGQGLEWMGWISAYNGNTNYAQKLQGRVTMTTDTSTSTAYMEL
RSLRSDDTAVYYCARSSGNMVSWKDMWGQGTLVTVSSTSGQAGQHHHHHHG
AYPYDVPDYAS [SEQ ID NO: 758]

TABLE 160

ET200-010

DNA Sequence
caatctgccctgactcagcctgcctccgtgtctgggtctcctggacagtcgatcaccatctcctgcactggaaccagcagtgacgt
tggtggttataactctgtctcctggtaccaacaacacccaggcaaagccccagactcatgatttatgatgtcagtaatcggccctc
aggggtttctaatcgcttctctggctccaagtctggcaacacggcctcctgaccatctctgggctccaggctgaggacgaggct
gattattactgcagctcatatacaagcagcagcaccccctttagtcttcggaactgggaccaaggtcaccgtcctaggttctagagg
tggtggtggtagcggcggcggcggctctggtggtggtggatccctcgagatggcccaggtgcagctggtgcagtctggggct
gaggtgaagaagcctggggcctcagtgaaggtctcctgcaaggcttctggttacacctttaccagctatggtatcagctgggtgc
gacaggcccctggacaagggcttgagtggatgggatggatcagcgcttacaatggtaacacaaactatgcacagaagctccag
ggcagagtcaccatgaccacagacacatccacgagcacagcctacatggagctgaggagcctgagatctgacgacacggcc
gtgtattactgtgcgcgcggtgctgttgcttaccatgattgggtcaaggtactctggtgaccgtctcctcaactagtggccaggcc
ggccagcaccatcaccatcaccatggcgcatacccgtacgacgttccggactacgcttct [SEQ ID NO: 759]

Amino Acid Sequence
QSALTQPASVSGSPGQSITISCTGTSSDVGGYNSVSWYQQHPGKAPRLMIYDVSN
RPSGVSNRFSGSKSGNTASLTISGLQAEDEADYYCSSYTSSSTPLVFGTGTKVTVL
GSRGGGGSGGGGSGGGGSLEMAQVQLVQSGAEVKKPGASVKVSCKASGYTFTS
YGISWVRQAPGQGLEWMGWISAYNGNTNYAQKLQGRVTMTTDTSTSTAYMEL
RSLRSDDTAVYYCARGAVAYHDWGQGTLVTVSSTSGQAGQHHHHHHGAYPYD
VPDYAS [SEQ ID NO: 760]

TABLE 161

ET200-011

DNA Sequence
cagtctgtcgtgacgcagccgccctcagtgtctgcggccccaggacagagggtcaccatctcctgctctggaagcagctccaa
catttcgatttatgatgtatcctggtatcagcagctcccaggaacagcccccaaactcctcatttatggcaataataagcgaccctc
gggggattgctgaccgattctctggctccacgtctggcacgtcagccaccctgggcatcaccggactccagactggggacgagg
ccgattattactgcggaacatgggatgacagtctgagtggggggtgttcggcggagggaccaagctgaccgtcctaggttcta
gaggtggtggtggtagcggcggcggcggctctggtggtggtggatccctcgagatggcccagatgcagctggtgcaatctgga
ggctgaggtgaagaagcctggggcctcggtgaaggtctcctgcgaggcttctggaggcacccctcagcagctatgctatcaactgg
gtgcgacaggcccctggacaagggcttgagtggatgggagggatcatccctatgtttggtacagcacactacgcacagaagt
tccagggcagagtcacgattaccgcggacgaatccacgaaaacagcctacatggagctgagcagcctgagatctgaggacac
tgccgtgtattactgtgcgcgcggtgttcattacgcttcttcgatcattgggtcaaggtactctggtgaccgtctcctcaactagtg
gccaggccggccagcaccatcaccatcaccatggcgcatacccgtacgacgttccggactacgcttct [SEQ ID NO:
761]

Amino Acid Sequence
QSVVTQPPSVSAAPGQRVTISCSGSSSNISIYDVSWYQQLPGTAPKLLIYGNNKRP
SGIADRFSGSTSGTSATLGITGLQTGDEADYYCGTWDDSLSGGVFGGGTKLTVLG
SRGGGGSGGGGSGGGGSLEMAQMQLVQSGAEVKKPGSSVKVSCEASGGTLSSY

TABLE 161-continued

ET200-011

AINWVRQAPGQGLEWMGGIIPMFGTAHYAQKFQGRVTITADESTKTAYMELSSL
RSEDTAVYYCARGVHYASFDHWGQGTLVTVSSTSGQAGQHHHHHHGAYPYDV
PDYAS [SEQ ID NO: 762]

TABLE 162

ET200-012

DNA Sequence
cagtctgtgttgacgcagccgccctcagtgtctgcggccgcaggacagaaggtcaccatctcctgctctggaagcgactccaac
attgggaataattatgtgtcctggtatcaacacctcccagggacagccccaaactcctcatttatgacgttaaaaatcgaccctca
gggattcctgaccggttctccggctccaagtctggctcgtcagccaccctaggcatcgccggactccagcctggggacgaggc
cgattattactgcgaacatgggacagtcggctggatgcctatgtcttcggaactgggaccaaggtcaccgtcctaggttctaga
ggtggtggtggtagcggcggcggcggctctggtggtggtggatccctcgagatggcccagatgcagctggtgcaatctggag
ctgaggtgaagaagcctggggcctcagtgaaggtctcctgcaagacttctggtttccccttttaatatctttggaatcacctgggtgc
gacaggcccctggacaagggcttgagtggatgggatggatcagcggttacaacggtaacacagactacccacagaagttcca
gggcagagtcaccatgtccacagacacatccacgagtacagcctacatggagctgaggaacctgaaatctgacgacacggcc
gtgtattactgtgcgcgcggtgcttacggtggtatggatacttgggtcaaggtactctggtgaccgtctcctcaactagtggcca
ggccggccagcaccatcaccatcaccatggcgcatacccgtacgacgttccggactacgcttct [SEQ ID NO: 763]

Amino Acid Sequence
QSVLTQPPSVSAAAGQKVTISCSGSDSNIGNNYVSWYQHLPGTAPKLLIYDVKNR
PSGIPDRFSGSKSGSSATLGIAGLQPGDEADYYCGTWDSRLDAYVFGTGTKVTVL
GSRGGGGSGGGGSGGGGSLEMAQMQLVQSGAEVKKPGASVKVSCKTSGFPFNI
FGITWVRQAPGQGLEWMGWISGYNGNTDYPQKFQGRVTMSTDTSTSTAYMELR
NLKSDDTAVYYCARGAYGGMDTWGQGTLVTVSSTSGQAGQHHHHHHGAYPY
DVPDYAS [SEQ ID NO: 764]

TABLE 163

ET200-013

DNA Sequence
cagtctgtcgtgacgcagccgccctcagtgtctggggcccaggggcagagggtcaccatctcctgcactgggagcacctccaa
catcggggcaggttatgatgtacactggtatcagcagcttccaggaacagcccccaaactcctcatctatactaacaactttcggc
cctcaggggtccctgaccgattctctgcctccaagtctggcacttcagcttcctggccatcactggtctccaggctgaggatgag
gctgattattactgcggaacatgggacagcctgagtgcgttgttgttcggcggagggaccaaggctgaccgtcctaggttcta
gaggtggtggtggtagcggcggcggcggctctggtggtggtggatccctcgagatggccgaggtgcagctggtggagtctgg
aactgaggtgaagaagcctggggcctcagtgaaagtctcctgcaaggcttctggttacatgtttaccagttatggtctcaactggg
tgcgacaggcccctggacaagggcttgagtggatgggatggatcagcgctaacaatggtaagacaaattatgctaagaaattcc
aggacagagtcaccatgaccagagacactccacgagcacaggctacatggaactgaggagcctgagatctgacgacacgg
ccgtatattactgtgcgcgccatatcggtggttcttacttcgatcgttgggtcaaggtactctggtgaccgtctcctcaactagtgg
ccaggccggccagcaccatcaccatcaccatggcgcatacccgtacgacgttccggactacgcttct [SEQ ID NO: 765]

Amino Acid Sequence
QSVVTQPPSVSGAPGQRVTISCTGSTSNIGAGYDVHWYQQLPGTAPKLLIYTNNF
RPSGVPDRFSASKSGTSASLAITGLQAEDEADYYCGTWDSSLSAVVFGGGTKLT
VLGSRGGGGSGGGGSGGGGSLEMAEVQLVESGTEVKKPGASVKVSCKASGYMF
TSYGLNWVRQAPGQGLEWMGWISANNGKTNYAKKFQDRVTMTRDTSTSTGY
MELRSLRSDDTAVYYCARHIGGSYFDRWGQGTLVTVSSTSGQAGQHHHHHHGA
YPYDVPDYAS [SEQ ID NO: 766]

TABLE 164

ET200-014

DNA Sequence
tcctatgtgctgactcagccaccctcagtgtcagtggccccaggaaagacggccaggattacctgtgggggaaacaacattgga
agtaaaagtgtgcactggtaccagcagaagccaggccaggcccctgtgctggtcatctattatgatagcgaccggccctcagg
gatccctgagcgattctctggctccaactctgggaacacggccaccctgaccatcagcagggtcgaagccggggatgaggcc
gactattactgtcaggtgtgggatagtagtagtgatcattatgtcttcggaactgggaccaaggtcaccgtcctaggttctagaggt
ggtggtggtagcggcggcggcggctctggtggtggtggatccctcgagatggccgaggtgcagctggtggagactggggga
ggcttggtacagcctgggggtccctgagactctcctgtgcagcctctggattcacctttagcagctatgccatgagctgggtcc
gccaggctccagggaaggggctggagtgggtctcagctattagtggtagtgatggtagcacatactacgcagactccgtgaag

TABLE 164-continued

ET200-014 ggccggttcaccatctccagagacaattccaagaacacgctgtatctgcaaatgaacagcctgagagacgaggacacggccgt
atattactgtgcgcgctctcatgaagctaacctggttggtgattggtggggtcaaggtactctggtgaccgtctcctcaactagtgg
ccaggccggccagcaccatcaccatcaccatggcgcatacccgtacgacgttccggactacgcttct [SEQ ID NO: 767]

Amino Acid Sequence
SYVLTQPPSVSVAPGKTARITCGGNNIGSKSVHWYQQKPGQAPVLVIYYDSDRPS
GIPERFSGSNSGNTATLTISRVEAGDEADYYCQVWDSSSDHYVFGTGTKVTVLGS
RGGGGSGGGGSGGGGSLEMAEVQLVETGGGLVQPGGSLRLSCAASGFTFSSYA
MSWVRQAPGKGLEWVSAISGSDGSTYYADSVKGRFTISRDNSKNTLYLQMNSL
RDEDTAVYYCARSHEANLVGDWWGQGTLVTVSSTSGQAGQHHHHHHGAYPY
DVPDYAS [SEQ ID NO: 768]

TABLE 165

ET200-015

DNA Sequence
cagtctgtggtgactcagccacccctcagtgtcagtggccccaggaaagacggccaggattacctgtgggggaaacaacattgg
aagtaaaagtgtgcactggtaccagcagaagccaggccaggcccctgtgctggtcatctattatgatagcgaccggccctcagg
gatccctgagcgattctctggctccaactctgggaacacggccaccctgaccatcagcagggtcgaagccggggatgaggcc
gactattactgtcaggtgtgggatagtagtagtgatgtggttttcggcggagggaccaagctgaccgtcctaggttctagaggt
gtggtggtagcggcggcggcggctctggtggtggtggatccctcgagatggccgaggtccagctggtacagtctggagctga
ggtgaagaagcctggggcctcagtgaaggtctcctgcaaggcttctggttacacctttaccagctacggtatcagctgggtgcga
caggcccctggacaagggcttgagtggatgggatggatcagcgcttacaatggtaacacaaaactatgcacagaagctccaggg
cagagtcaccatgaccacagacacatccacgagcacagcctacatggagctgaggagcctgagatctgacgacacggccgtg
tattactgtgcgcgctggggtggtttcggtgctgttgatcattggggtcaaggtactctggtgaccgtctcctcaactagtggccag
gccggccagcaccatcaccatcaccatggcgcatacccgtacgacgttccggactacgcttct [SEQ ID NO: 769]

Amino Acid Sequence
QSVVTQPPSVSVAPGKTARITCGGNNIGSKSVHWYQQKPGQAPVLVIYYDSDRP
SGIPERFSGSNSGNTATLTISRVEAGDEADYYCQVWDSSSDVVFGGGTKLTVLGS
RGGGGSGGGGSGGGGSLEMAEVQLVQSGAEVKKPGASVKVSCKASGYTFTSYG
ISWVRQAPGQGLEWMGWISAYNGNTNYAQKLQGRVTMTTDTSTSTAYMELRS
LRSDDTAVYYCARWGGFGAVDHWGQGTLVTVSSTSGQAGQHHHHHHGAYPY
DVPDYAS [SEQ ID NO: 770]

TABLE 166

ET200-016

DNA Sequence
tcttctgagctgactcaggaccctgctgtgtctgtgccttgggacagacagtcaagatcacgtgccaaggagacagcctcaca
gactaccatgcaaacctggtaccagcagaagccaggacaggcccctgtcgctgtcatctatgctacaaacaaccggcccactgg
gatcccagaccgattctctggttccagttccggaaacacagcttctttgaccatcactggggctcaggcggaagatgaggctgac
tattactgtaattcccgggacagcggcacggacgaagtgttattcggcggagggaccaagctgaccgtcctaggttctagaggt
ggtggtggtagcggcggcggcggctctggtggtggtggatccctcgagatggccgaggtgcagctggtggagactgggga
ggcctggtcaagcctgggggtccctgagactctcctgtgcagcctctggattcaccttcagtagctatagcatgaactgggtcc
gccaggctccagggaaggggctggagtgggtctcatccattagtagtagtagtagttacatatactacgcagactcagtgaagg
gccgattcaccatctccagagacaacgccaagaactcactgtatctgcaaatgaacagcctgagagccgaggacacggccgtg
tattactgtgcgcgcggtcagggttacgattactggggtcaaggtactctggtgaccgtctcctcaactagtggccaggccggcc
agcaccatcaccatcaccatggcgcatacccgtacgacgttccggactacgcttct [SEQ ID NO: 771]

Amino Acid Sequence
SSELTQDPAVSVALGQTVKITCQGDSLTDYHATWYQQKPGQAPVAVIYATNNRP
TGIPDRFSGSSSGNTASLTITGAQAEDEADYYCNSRDSGTDEVLFGGGTKLTVLG
SRGGGGSGGGGSGGGGSLEMAEVQLVETGGGLVKPGGSLRLSCAASGFTFSSYS
MNWVRQAPGKGLEWVSSISSSSSYIYYADSVKGRFTISRDNAKNSLYLQMNSLR
AEDTAVYYCARGQGYDWGQGTLVTVSSTSGQAGQHHHHHHGAYPYDVPDY
AS [SEQ ID NO: 772]

TABLE 167

ET200-017

DNA Sequence
Tcctatgtgctgactcagccaccctcggtgtcagtggccccaggaaagacggccaggattacctgtgggggaaacaacattgg
aagtaaaagtgtgcactggtaccagcagaagccaggccaggcccctgtgctggtcgtctatgatgatagcgaccggccctcag
ggatccctgagcgattctctggctccaactctgggaacacggccaccctgagcatcagcagggtcgaagccggggatgaggc
cgactattactgtcaggtgtgggatagtagtagtgatcatactgtcttcggaactgggaccaaggtcaccgtcctaggttctagag
gtggtggtggtagcggcggcggcggctctggtggtggtggatccctcgagatggcccaggtgcagctacagcagtggggcg
caggactgttgaagccttcggagaccctgtccctcacctgcgctgtctatggtgggtccttcagtggttactactggagctggatc
cgccagccccagggaaggggctggagtggattgggaaatcaatcatagtggaagcaccaactacaacccgtccctcaaga
gtcgagtcaccatatcagtagacacgtccaagaaccagttctccctgaagctgagctctgtgaccgccgcggacacggccgtgt
attactgtgcgcgctactaccgggtatggatatgtgggtcaaggtactctggtgaccgtctcctcaactagtggccaggccgg
ccagcaccatcaccatcaccatggcgcatacccgtacgacgttccggactacgcttct [SEQ ID NO: 773]

Amino Acid Sequence
SYVLTQPPSVSVAPGKTARITCGGNNIGSKSVHWYQQKPGQAPVLVVYDDSDRP
SGIPERFSGSNSGNTATLSISRVEAGDEADYYCQVWDSSSDHTVFGTGTKVTVLG
SRGGGGSGGGGSGGGGSLEMAQVQLQQWGAGLLKPSETLSLTCAVYGGSFSGY
YWSWIRQPPGKGLEWIGEINHSGSTNYNPSLKSRVTISVDTSKNQFSLKLSSVTA
ADTAVYYCARYYPGMDMWGQGTLVTVSSTSGQAGQHHHHHGAYPYDVPDY
AS [SEQ ID NO: 774]

TABLE 168

ET200-018

DNA Sequence
Caggctgtgctgactcagccgccctcaacgtctgggaccccggggcagagggtcaccatctcttgttctggaagcagctccaa
catcgggagaaatggtgtaaactggtaccagcagctcccaggagcggcccccaaagtcctcatctataatgataatcagcgacc
ctcaggggtccctgaccgagtctctggctccagtctggctcctcaggcaccctggccatcgatgggcttcggtctgaggatga
ggctgattattactgtgcggcatggatgacacctgcatggtgtggtattcggcggagggaccaagctgaccgtcctaggttct
agaggtggtggtggtagcggcggcggcggctctggtggtggtggatccctcgagatggcccaggtccagctggtacagtctg
gggctgaggtgaagaagcctggggcctcagtgaaggtctcctgcaaggtttccggatacaccctcaatgaattatccatgcactg
ggtgcgacaggctcctggaaaaggcttgagtggatgggaggttttgatcctgaagatggtgaaacaatctacgcacagaagtt
ccagggcagagtcaccatgaccgaggacacatctacagacacagcctacatggagctgagcagcctgagatctgaggacact
gccgtgtattactgtgcgcgcggtggttacggtgattcttgggtcaaggtactctggtgaccgtctcctcaactagtggccaggc
cggccagcaccatcaccatcaccatggcgcatacccgtacgacgttccggactacgcttct [SEQ ID NO: 775]

Amino Acid Sequence
QAVLTQPPSTSGTPGQRVTISCSGSSSNIGRNGVNWYQQLPGAAPKVLIYNDNQR
PSGVPDRVSGSQSGSSGTLAIDGLRSEDEADYYCAAWDDSLHGVVFGGGTKLTV
LGSRGGGGSGGGGSGGGGSLEMAQVQLVQSGAEVKKPGASVKVSCKVSGYTL
NELSMHWVRQAPGKGLEWMGGFDPEDGETIYAQKFQGRVTMTEDTSTDTAYM
ELSSLRSEDTAVYYCARGGYGDSWGQGTLVTVSSTSGQAGQHHHHHGAYPY
DVPDYAS [SEQ ID NO: 776]

TABLE 169

ET200-019

DNA Sequence
Aattttatgctgactcagccccactctgtgtcggagtctccggggaagacggtaaccatctcctgcacccgcagcagtggcagc
attgccagcaactatgtgcagtggtaccagcagcgccccgggcagtgcccccaccactgtgatctatgaggataaccaaagacc
ctctggggtccctgatcggttctctggctccatcgacagctcctccaactctgcctccctcaccatctctggactggagactgagg
acgaggctgactactactgtcagtcttatgatagcagcaattcttgggtgttcggcggagggaccaagctgaccgtcctaggttct
agaggtggtggtggtagcggcggcggcggctctggtggtggtggatccctcgagatggcccaggtgcagctggtgcaatctg
gggctgaggtgaagaggcctgggtcctcggtgaaggtctcctgcacggcttctggaggcaccttcagcagcgatgctatcagct
gggtgcgacaggcccctggacaagggcttgagtggatgggaggaatcatccctatgtttggtacagcaaactacgcacagaag
ttccagggcagagtcacgattaccgcggacgaatccacgagcacagcctacatggagctgagcagcctgagatctgaggaca
cggccgtgtattactgtgcgcgcgaaggttactactaccgtctgcttacctgggtctgttctgaacgacatctcttctgtttacgat
gaatgggtcaaggtactctggtgaccgtctcctcaactagtggccaggccggccagcaccatcaccatcaccatggcgcata
cccgtacgacgttccggactacgcttct [SEQ ID NO: 777]

Amino Acid Sequence
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSSNWVFGGGTKLTVL
GSRGGGGSGGGGSGGGGSLEMAQVQLVQSGAEVKRPGSSVKVSCTASGGTFSS TABLE 169-continued

ET200-019

DAISWVRQAPGQGLEWMGGIIPMFGTANYAQKFQGRVTITADESTSTAYMELSS
LRSEDTAVYYCAREGYYYPSAYLGSVLNDISSVYDEWGQGTLVTVSSTSGQAGQ
HHHHHHGAYPYDVPDYAS [SEQ ID NO: 778]

TABLE 170

ET200-020

DNA Sequence
Cagtctgtcgtgacgcagccgccctcagtgtctgcggccccaggacagaaggtcaccatctcctgctctggaagcacctccaa
cattggaaataatgatgtatcctggtaccagcagctcccaggaacagcccccaaactcctcatttatgacaataataagcgaccct
cagggattcctgaccgattctctggctccaagtctggcacgtcagccaccctgggcatcaccggactccagactggggacgag
gccgattattactgcgcgaacatggatagcagcgtgagtgcttcttgggtcttcggcagagggaccaagctgaccgtcctaggtt
ctagaggtggtggtggtagcggcggcggcggctctggtggtggtggatccctcgagatggcccaggtgcagctggtgcagtct
ggagctgaggtgaagaagcctggggcctcagtgaaggtctcctgcaaggcttctggttacacctttaccagctatggtatcagct
gggtgcgacaggcccctggacaagggcttgagtggatgggatggatcagcgcttacaatggtaacacaaactatccacagaa
gctccagggcagagtcaccatgaccacagacccatccacgagcacagcctacatggagctgaggagcctgagatctgacgac
acggccgtgtattactgtgcgcgctctatgactttctttcgattactgggggtcaaggtactctggtgaccgtctcctcaactagtggcc
aggccggccagcaccatcaccatcaccatggcgcatacccgtacgacgttccggactacgcttct [SEQ ID NO: 779]

Amino Acid Sequence
QSVVTQPPSVSAAPGQKVTISCSGSTSNIGNNDVSWYQQLPGTAPKLLIYDNNKR
PSGIPDRFSGSKSGTSATLGITGLQTGDEADYYCGTWDSSVSASWVFGRGTKLTV
LGSRGGGGSGGGGSGGGGSLEMAQVQLVQSGAEVKKPGASVKVSCKASGYTFT
SYGISWVRQAPGQGLEWMGWISAYNGNTNYPQKLQGRVTMTTDPSTSTAYMEL
RSLRSDDTAVYYCARSMTSFDWGQGTLVTVSSTSGQAGQHHHHHHGAYPYD
VPDYAS [SEQ ID NO: 780]

TABLE 171

ET200-021

DNA Sequence
Cagtctgtgttgacgcagccgccctcagtgtctgcggccccaggacagaaggtcaccatctcctgctctggaagcaactccaa
cattgggaataattatgtatcctggtatcagcaactcccagggacagccccaaactcctcatttatgacaataataagcgaccctc
agggattcctgaccgattctctggctccaggtctggcacgtcagccaccctgggcatcaccggactccagactggggacgagg
ccgattattactgcgcgaacatggaataccactgtgactcctggtatgtcttcggaactgggaccaaggtcaccgtcctaggttcta
gaggtggtggtggtagcggcggcggcggctctggtggtggtggatccctcgagatggccgaagtgcagctggtgcagtctgg
agctgaggtgaagaagcctggggcctcagtgaaggtctcctgcaaggcttctggttacacctttaccagctatggtatcagctgg
gtgcgacaggcccctggacaagggcttgagtggatgggatggatcagcgcttacaatggtaacacaaactatgcacagaagct
ccagggcagagtcaccatgaccacagacacatccacgagcacagcctacatggagctgaggagcctgagatctgacgacac
cgccatgtattactgtgcgcgctctgtttacgacctggatacttgggtcaaggtactctggtgaccgtctcctcaactagtggcca
ggccggccagcaccatcaccatcaccatggcgcatacccgtacgacgttccggactacgcttct [SEQ ID NO: 781]

Amino Acid Sequence
QSVLTQPPSVSAAPGQKVTISCSGSNSNIGNNYVSWYQQLPGTAPKLLIYDNNKR
PSGIPDRFSGSRSGTSATLGITGLQTGDEADYYCGTWNTTVTPGYVFGTGTKVTV
LGSRGGGGSGGGGSGGGGSLEMAEVQLVQSGAEVKKPGASVKVSCKASGYTFT
SYGISWVRQAPGQGLEWMGWISAYNGNTNYAQKLQGRVTMTTDTSTSTAYME
LRSLRSDDTAMYYCARSVYDLDTWGQGTLVTVSSTSGQAGQHHHHHHGAYPY
DVPDYAS [SEQ ID NO: 782]

TABLE 172

ET200-022

DNA Sequence
cagtctgtcgtgacgcagccgccctcagtgtctgcggccccaggacagaaggtcaccatctcctgctctggaagcagctccaa
cattgggaataattatgtatcctggtaccagcagctcccaggaacagcccccaaactcctcatttatgacaataataagcgaccct
cagggattcctgaccgattctctggctccaagtctggcacgtcagccaccctgggcatcaccggactccagactggggacgag
gccgattattactgcgcgaacatggatagcagcctggggccccttatgtcttcggaactgggaccaaggtcaccgtcctaggtt
ctagaggtggtggtggtagcggcggcggcggctctggtggtggtggatccctcgagatggccgaggtgcagctggtgcagtc
ttgggggaggctcggaacagcctggcaggtccctgagactctcctgtgcagcctctggattcacctttgatgattatgccatgcact
gggtccggcaagctccagggaagggcctggagtgggtctcaggtattagttggaatagcggtagcataggctatgcggactct
gtgaagggccgattcaccatctccagagacaacgccaagaattccctgtatctgcaaatgaacagtctgagagctgaggacacc

TABLE 172-continued

ET200-022 gccatgtattactgtgcgcgctaccgtcaggttggttctgcttacgattcttggggtcaaggtactctggtgaccgtctcctcaacta
gtggccaggccggccagcaccatcaccatcaccatggcgcatacccgtacgacgttccggactacgcttct [SEQ ID
NO: 783]

Amino Acid Sequence
QSVVTQPPSVSAAPGQKVTISCSGSSSNIGNNYVSWYQQLPGTAPKLLIYDNNKR
PSGIPDRFSGSKSGTSATLGITGLQTGDEADYYCGTWDSSLGAPYVFGTGTKVTV
LGSRGGGGSGGGGSGGGGSLEMAEVQLVQSWGGSEQPGRSLRLSCAASGFTFD
DYAMHWVRQAPGKGLEWVSGISWNSGSIGYADSVKGRFTISRDNAKNSLYLQM
NSLRAEDTAMYYCARYRQVGSAYDSWGQGTLVTVSSTSGQAGQHHHHHGAY
PYDVPDYAS [SEQ ID NO: 784]

TABLE 173

ET200-023

DNA Sequence
ctgcctgtgctgactcagccaccctcggtgtcagtggccccaggaaagacggccaggattacctgtgggggaaacaacattgg
aagtaaaagtgtgcactggtatcagcagaagccaggccaggcccctgtgctggtcgtctatgctgatagcgaccggccctcag
ggatccctgagcgattctctggctccaactctgggaacacggccaccctgaccatcagcagggtcgaagccggggatgaggc
cgactattactgtcaggtgtgggatagtagtagttatcataattatgtcttcggaactgggaccaaggtcaccgtcctaggttctaga
ggtggtggtggtagcggcggcggcggctctggtggtggtggatcctcgagatggccgaggtgcagctggtgcagtctggag
ctgaggtgaagaagcctggggcctcagtgaaggtctcctgcaaggcttctggttacacctttaccagctatggtatcagctgggt
gcgacaggcccctggacaagggcttgagtggatgggatggataacacaaactatgcacagaagctcc
agggcagagtcaccatgaccacagacacatccacgagcacagcctacatggagctgagcagcctgagatctgaggacaccg
ccatgtattactgtgcgcgctactgggtttcggtgtttctgatcgttgggtcaaggtactctggtgaccgtctcctcaactagtgg
ccaggccggccagcaccatcaccatcaccatggcgcatacccgtacgacgttccggactacgcttct [SEQ ID NO:
785]

Amino Acid Sequence
LPVLTQPPSVSVAPGKTARITCGGNNIGSKSVHWYQQKPGQAPVLVVYADSDRP
SGIPERFSGSNSGNTATLTISRVEAGDEADYYCQVWDSSSYHNYVFGTGTKVTVL
GSRGGGGSGGGGSGGGGSLEMAEVQLVQSGAEVKKPGASVKVSCKASGYTFTS
YGISWVRQAPGQGLEWMGWISAYNGNTNYAQKLQGRVTMTDTSTSTAYMEL
SSLRSEDTAMYYCARYWGFGVSDRWGQGTLVTVSSTSGQAGQHHHHHGAYP
YDVPDYAS [SEQ ID NO: 786]

TABLE 174

ET200-024

DNA Sequence
aattttatgctgactcagccccactctgtgtcggagtctccggggaagacggtaaccatctcctgcaccggcagcagtggcagc
attgccagcaactatgtgcagtggtaccagcagcgccccgggcagtgcccccaccactgtgatctatgaggataaccaaagacc
ctctggggtccccgatcggttctctggctccatcgacagctcctccaactctgcctcctcaccatctctggactgaagactgagg
acgaggctgactactactgtcagtcttatgacagcagcaatctttgggtgttcggcggagggaccaagctgaccgtcctaggttct
agaggtggtggtggtagcggcggcggcggctctggtggtggtggatcctcgagatggcccagatgcagctggtgcagtctg
gggctgaggtgaagaagcctgggtcctcggtgaaggtctcctgcaaggcttctggaggcaccttcagcagctatgctatcagct
gggtgcgacaggcccctggacaagggcttgagtggatgggagggatcatccctatctttggtacagcaaactacgcacagaag
ttccagggcagagtcacgattaccgcggacgaatccacgagcacagcctacatggagctgagcagcctgagatctgaggaca
ctgccgtgtattactgtgcgcgctacaactactactactacgattcttgggtcaaggtactctggtgaccgtctcctcaactagtgg
ccaggccggccagcaccatcaccatcaccatggcgcatacccgtacgacgttccggactacgcttct [SEQ ID NO:
787]

Amino Acid Sequence
NFMLTQPHSVSESPGKTVTISCTGSSGSIASNYVQWYQQRPGSAPTTVIYEDNQR
PSGVPDRFSGSIDSSSNSASLTISGLKTEDEADYYCQSYDSSNLWVFGGGTKLTVL
GSRGGGGSGGGGSGGGGSLEMAQMQLVQSGAEVKKPGSSVKVSCKASGGTFSS
YAISWVRQAPGQGLEWMGGIIPIFGTANYAQKFQGRVTITADESTSTAYMELSSL
RSEDTAVYYCARYNYYYYDSWGQGTLVTVSSTSGQAGQHHHHHGAYPYDVP
DYAS [SEQ ID NO: 788]

TABLE 175

ET200-025

DNA Sequence
gacatccagatgacccagtctccatcctccctgtctgcatctgtaggagacagagtcaccatcacttgccgggcaagtcagagca
ttagcagctatttaaattggtatcagcagaaaccagggaaagcccctaagctcctgatctatgctgcatccagtttgcaaagtggg
gtcccatcaaggttcagtggcagtggatctgggacagatttcactctcaccatcagcagtctgcaacctgaagattttgcaacttac
tactgtcaacagagttacagtaccccattcactttcggccctgggaccaaagtggatatcaaacgttctagaggtggtggtggtag
cggcggcggcggctctggtggtggtggatccctcgagatggccgaggtgcagctggtgcagtctggggctgaggtgaagaa
gcctgggtcctcggtgaaggtctcctgcaaggcttctggaggcaccttcagcagctatgctatcagctgggtgcgacaggcccc
tggacaagggcttgagtggatgggaggatcatccctatctttggtacagcaaactacgcacagaagttccagggcagagtcac
gattaccgcggacgaatccacgagcacagcctacatggagctgagcagcctgagatctgaggacaccgccatgtattactgtg
cgcgctactgggttacgactcttacgatgaatggggtcaaggtactctggtgaccgtctcctcaactagtggccaggccggcc
agcaccatcaccatcaccatggcgcatacccgtacgacgttccggactacgcttct [SEQ ID NO: 789]

Amino Acid Sequence
DIQMTQSPSSLSASVGDRVTITCRASQSISSYLNWYQQKPGKAPKLLIYAASSLQS
GVPSRFSGSGSGTDFTLTISSLQPEDFATYYCQQSYSTPFTFGPGTKVDIKRSRGG
GGSGGGGSGGGGSLEMAEVQLVQSGAEVKKPGSSVKVSCKASGGTFSSYAISW
VRQAPGQGLEWMGGIIPIFGTANYAQKFQGRVTITADESTSTAYMELSSLRSEDT
AMYYCARYWGYDSYDEWGQGTLVTVSSTSGQAGQHHHHHHGAYPYDVPDYA
S [SEQ ID NO: 790]

TABLE 176

ET200-026

DNA Sequence
aatttttatgctgactcagccccactctgtgtcggagtctccggggaagacggtaaccatctcctgcaccggcagcagtggcagc
attgccagcaactatgtgcagtggtaccagcagcgcccgggcagtgcccccaccactgtgatctatgaggataaccaaagacc
ctctgggggtccctgatcggttctctggctccatcgacagctcctccaactctgcctccctcaccatctctggactgaagactgagg
acgaggctgactactactgtcagtcttatgatagcagcaattgggtgttcggcggagggaccaagctgaccgtcctaggttctag
aggtggtggtggtagcggcggcggcggctctggtggtggtggatccctcgagatggccgaggtccagctggtgcagtctggg
gctgaggtgaagaagcctgggtcctcggtgaaggtctcctgcaaggcttctggaggcaccttcagcagctatgctatcagctgg
gtgcgacaggcccctggacaagggcttgagtggatgggaggatcatccctatctttggtacagcaaactacgcacagaagttc
cagggcagagtcacgattaccgcggacgaatccacgagcacagcctacatggagctgagcagcctgagatctgaggacacg
gccgtgtattactgtgcgcgcaacaaccattactacaacgattactgggtcaaggtactctggtgaccgtctcctcaactagtgg
ccaggccggccagcaccatcaccatcaccatggcgcatacccgtacgacgttccggactacgcttct [SEQ ID NO:
791]

Amino Acid Sequence
NFMLTQPHSVSESPGKTVTISCTGSSGSIASNYVQWYQQRPGSAPTTVIYEDNQR
PSGVPDRFSGSIDSSSNSASLTISGLKTEDEADYYCQSYDSSNWVFGGGTKLTVL
GSRGGGGSGGGGSGGGGSLEMAEVQLVQSGAEVKKPGSSVKVSCKASGGTFSS
YAISWVRQAPGQGLEWMGGIIPIFGTANYAQKFQGRVTITADESTSTAYMELSSL
RSEDTAVYYCARNNHYYNDYWGQGTLVTVSSTSGQAGQHHHHHHGAYPYDVP
DYAS [SEQ ID NO: 792]

TABLE 177

ET200-027

DNA Sequence
cagtctgtgttgacgcagccgccctcagtgtctggggcccagggcaggggtcaccatcccctgcactgggagcagctcca
acatcggggcaggttatgatgtacactggtaccagcagcttccaggaacagcccccaaactcctcatctatggtaacaacaatcg
gccctcaggggtccctgaccgcttctctggctccaggtctggctcctcagcctccctggccatcactgggctccaggctgaggat
gaggctgattattactgccagtcctatgacagcagcctgagtgatgtggtattcggcggagggaccaagctcaccgtcctaggtt
ctagaggtggtggtggtagcggcggcggcggctctggtggtggtggatccctcgagatggccgaggtccagctggtgcagtct
ggggctgaggtgaagaagcctggggctacagtgaaaatctcctgcaaggtttctggatacaccttcaccgactactacatgcact
gggtgcaacaggcccctggaaagggcttgagtggatgggacttgttgatcctgaagatggtgaaacaatatacgcagagaag
ttccagggcagagtcaccataaccgcggacacgtctacagacacagcctacatggagctgagcagcctgagatctgaggaca
cggccgtgtattactgtgcgcgctactggtcttactctttcgactacctgtacatgccgaaggtaacgattggtgggtcaaggta
ctctggtgaccgtctcctcaactagtggccaggccggccagcaccatcaccatcaccatggcgcatacccgtacgacgttccgg
actacgcttct [SEQ ID NO: 793]

Amino Acid Sequence
QSVLTQPPSVSGAPGQGVTIPCTGSSSNIGAGYDVHWYQQLPGTAPKLLIYGNNN
RPSGVPDRFSGSRSGSSASLAITGLQAEDEADYYCQSYDSSLSDVVFGGGTKVTV
LGSRGGGGSGGGGSGGGGSLEMAEVQLVQSGAEVKKPGATVKISCKVSGYTFT
DYYMHWVQQAPGKGLEWMGLVDPEDGETIYAEKFQGRVTITADTSTDTAYME

TABLE 177-continued

ET200-027

LSSLRSEDTAVYYCARYWSYSFDYLYMPEGNDWWGQGTLVTVSSTSGQAGQH
HHHHHGAYPYDVPDYAS [SEQ ID NO: 794]

TABLE 178

ET200-028

DNA Sequence
cagtctgtgttgactcagccacccgcagcgtctgggaccccggacagagagtcaccatctcttgttctggggggcgtctccaac
atcgggagtggtgctctaaattggtaccagcaactcccaggaacggccccaaactcctcatctatagttacaatcagcggccct
caggggtctctgaccgattctctggctccaggtctgccacctcagcctcctggccatcagtgggctccagtctgaggatgaggc
tgattattactgtgcaacctgggatgatagtgtgaatggttgggtgttcggcggagggaccaagctgaccgtcctaggttctagag
gtggtggtggtagcggcggcggcggctctggtggtggtggatccctcgagatggcccaggtccagctggtacagtctggagct
gaggtgaagaagcctggggattcagtgaaggtctcctgcaagccttctggttacaatttttctcaactatggtatcaactgggtgcg
acaggcccctggacaagggcttgagtggatggatggattagcacttacaccggtaacacaaactatgcacagaagctgcagg
gcagagtcaccttcaccacagacacatccacgagcacagcctacatggagatgaggagcctgagatctgacgacacggccgt
gtattactgtgcgcgcgacctgtactactacgaaggtgttgattactggggtcaaggtactctggtgaccgtctcctcaactagtgg
ccaggccggccagcaccatcaccatcaccatggcgcatacccgtacgacgttccggactacgcttct [SEQ ID NO: 795]

Amino Acid Sequence
QSVLTQPPAASGTPGQRVTISCSGGVSNIGSGALNWYQQLPGTAPKLLIYSYNQR
PSGVSDRFSGSRSATSASLAISGLQSEDEADYYCATWDDSVNGWVFGGGTKLTV
LGSRGGGGSGGGGSGGGGSLEMAQVQLVQSGAEVKKPGDSVKVSCKPSGYNFL
NYGINWVRQAPGQGLEWMGWISTYTGNTNYAQKLQGRVTFTTDTSTSTAYME
MRSLRSDDTAVYYCARDLYYYEGVDYWGQGTLVTVSSTSGQAGQHHHHHGA
YPYDVPDYAS [SEQ ID NO: 796]

TABLE 179

ET200-029

DNA Sequence
caggctgtgctgactcagccaccctcagtgtcagtggccccaggaaagacggccagggttacctgtgggggaaacaacattg
gaagtgaaagtgtgcactggtaccagcagaagccaggccaggcccctgtgttggtcatctattatgataccgaccggccctcag
ggatccctgagcgattctctggctccactctgggaccacggccaccctgaccatcagcagggtcgaagccggggatgaggc
cgactattactgtcaggtgtgggatagtagtagggatcatgtggtattcggcggagggaccaagctgaccgtcctaggttctaga
ggtggtggtggtggtagcggcggcggcggctctggtggtggtggatccctcgagatggcccaggtgcagctggtgcagtctggg
gaggcgtggtccagcctggggggtccctgagactctcctgtgcggcctctggattcaccttcagtagctatgctatgcactgggt
ccgccaggctccaggcaagggactggagtgggtggcagttatatcatatgatggaagcaataaatactacgcagactccgtga
agggccgattcaccatctccagagacaattccaagaacacgctgtatctgcaaatgaacagcctgagagctgaggacacggcc
gtgtattactgtgcgcgcgctcttacttcacttctggttctacgattactggggtcaaggtactctggtgaccgtctcctcaactagtgg
ccaggccggccagcaccatcaccatcaccatggcgcatacccgtacgacgttccggactacgcttct [SEQ ID NO: 797]

Amino Acid Sequence
QAVLTQPPSVSVAPGKTARVTCGGNNIGSESVHWYQQKPGQAPVLVIYYDTDRP
SGIPERFSGSHSGTTATLTISRVEAGDEADYYCQVWDSSRDHVVFGGGTKLTVLG
SRGGGGSGGGGSGGGGSLEMAQVQLVQSGGGVVQPGRSLRLSCAASGFTFSSY
AMHWVRQAPGKGLEWVAVISYDGSNKYYADSVKGLFTISRDNSKNTLYLQMN
SLRAEDTAVYYCARSYFTSGFYDYWGQGTLVTVSSTSGQAGQHHHHHGAYPY
DVPDYAS [SEQ ID NO: 798]

TABLE 180

ET200-030

DNA Sequence
cagtctgtcgtgacgcagccgccctcagtgtctggggcccagggcagagggtcaccatctcctgcactgggagcagttccaa
catcggggcaggttatgatgtaaattggtatcagcagtttccaggaacggccccaaactcctcatctatggtaacagcaatcggc
cctcaggggtccctgaccgattctctggctccaagtctggcacctcagcctcctggccatcactgggctccaggctgaggatg
aggctgattattactgccagtcctatgacagcagcctgagtggctcttatgtcttcggaactgggaccaaggtcaccgtcctaggtt
ctagaggtggtggtggtagcggcggcggcggctctggtggtggtggatccctcgagatggcccagatgcagctggtgcagtct
ggggctgaggtgaagaagcctggggcctcagtgaaggtctcctgcaaggcttccggatacacccactgaattatccatgcac
tgggtgcgacaggctcctgaaaagggcttgagtggatgggaggttttgatcctgaagatggtgaaacaatctacgcacagaag TABLE 180-continued

ET200-030 ttccagggcagagtcaccatgaccgaggacacatctacagacacagcctacatggagctgagcagcctgagatctgaggaca
ctgccgtgtattactgtgcgcgcatgtcttctatgtactacgattggggtcaaggtactctggtgaccgtctcctcaactagtggcca
ggccggccagcaccatcaccatcaccatggcgcatacccgtacgacgttccggactacgcttct [SEQ ID NO: 799]

Amino Acid Sequence
QSVVTQPPSVSGAPGQRVTISCTGSSSNIGAGYDVNWYQQFPGTAPKLLIYGNSN
RPSGVPDRFSGSKSGTSASLAITGLQAEDEADYYCQSYDSSLSGSYVFGTGTKVT
VLGSRGGGGSGGGGSGGGGSLEMAQMQLVQSGAEVKKPGASVKVSCKASGYT
LTELSMHWVRQAPGKGLEWMGGFDPEDGETIYAQKFQGRVTMTEDTSTDTAY
MELSSLRSEDTAVYYCARMSSMYYDWGQGTLVTVSSTSGQAGQHHHHHHGAY
PYDVPDYAS [SEQ ID NO: 800]

TABLE 181

ET200-031

DNA Sequence
tcctatgtgctgactcagccaccctcagtgtcagtggccccaggaaagacggccaggattacctgtgggggaaacaacattgga
agtaaaagtgtgcactggtaccagcagaagccaggccaggcccctgtgctggtcatctattatgatagcgaccggccctcagg
gatccctgagcgattctctggctccaactctgggaacacggccaccctgaccatcagcagggtcgaagccggggatgaggc
gactattactgtcaggtgtgggatagtagtagtgattatgtcttcggaactgggaccaaggtcaccgtcctaggttctagaggtggt
ggtggtagcggcggcggcggctctggtggtggtggatccctcgagatggccgaggtgcagctggtggagactgggggaggc
ttggtcaagcctggagggtccctgagactctcctgtgcagcctctggattcaccgtcagtgactactacatgagctggatccgcca
ggctccagggaagggcctggagtggattcatacattagtggtagtggtaatagcatatactacgcagactctgtgaagggccga
ttcaccatctccagggacaacgccaagaactcactggatctgcaaatgaccagcctgagagccgaggacacggccgtatatta
ctgtgcgcgctctactaaattcgattactgggtcaaggtactctggtgaccgtctcctcaactagtggccaggccggccagcac
catcaccatcaccatggcgcatacccgtacgacgttccggactacgcttct [SEQ ID NO: 801]

Amino Acid Sequence
SYVLTQPPSVSVAPGKTARITCGGNNIGSKSVHWYQQKPGQAPVLVIYYDSDRPS
GIPERFSGSNSGNTATLTISRVEAGDEADYYCQVWDSSSDYVFGTGTKVTVLGSR
GGGGSGGGGSGGGGSLEMAEVQLVETGGGLVKPGGSLRLSCAASGFTVSDYYM
SWIRQAPGKGLEWISYISGSGNSIYYADSVKGRFTISRDNAKNSLDLQMTSLRAE
DTAVYYCARSTKFDYWGQGTLVTVSSTSGQAGQHHHHHHGAYPYDVPDYAS
[SEQ ID NO: 802]

TABLE 182

ET200-032

DNA Sequence
ctgcctgtgctgactcagccaccctcagcgtctgggaccccggggcagagggtcaccatctcttgttctggaagcagctccaac
gtcggaagttacactgtaaactggtaccggcaactcccaggaacggccccacactcctcatctataataataatcagcggccct
caggggtccctgaccgattctctgactccaagtctggcacctcggcctccctgaccattagtgggctccagcctgaggatgagg
ctgattattattgtgcagcatgggatgacaggctgggtggttatgtcttcggaactgggaccaaggtcaccgtcctaggttctaga
ggtggtggtggtagcggcggcggcggctctggtggtggtggatccctcgagatggccgaggtgcagctggtggagtctgggg
gagaggtgaaaaagccgggggagtctctgaagatctcctgtaagggttctggatacagctttaccaactactggatcggctgggt
gcgccagatgcccgggaaaggcctggagtggatggggatcatctatcctggtgactctgataccagatacagcccgtccttcca
aggccaggtcaccatctcagccgacaagtccatcagcaccgcctacctacagtggagcagcctgaaggcctcggacaccgcc
atgtattactgtgcgcgctctactggttcttctcatatgtctgatgaatggggtcaaggtactctggtgaccgtctcctcaactagtgg
ccaggccggccagcaccatcaccatcaccatggcgcatacccgtacgacgttccggactacgcttct [SEQ ID NO: 803]

Amino Acid Sequence
LPVLTQPPSASGTPGQRVTISCSGSSSNVGSYTVNWYRQLPGTAPTLLIYNNNQRP
SGVPDRFSDSKSGTSASLTISGLQPEDEADYYCAAWDDRLGGYVFGTGTKVTVL
GSRGGGGSGGGGSGGGGSLEMAEVQLVQSGAEVKKPGESLKISCKGSGYSFTNY
WIGWVRQMPGKGLEWMGIIYPGDSDTRYSPSFQGQVTISADKSISTAYLQWSSL
KASDTAMYYCARSTGSSHMSDEWGQGTLVTVSSTSGQAGQHHHHHHGAYPYD
VPDYAS [SEQ ID NO: 804]

TABLE 183

ET200-033

DNA Sequence
aatttatgctgactcagcccactctgtgtcggagtctccggggaagacggtaaccatctcctgcaccggcagcagtggcagc
attgccagcaactatgtgcagtggtaccagcagcgcccgggcagtgccccaccactgtgatctatgaggataaccaaagacc
ctctggggtccctgatcggttctctggctccatcgacagctcctccaactctgcctccctcaccatctctggactgaagactgagg
acgaggctgactactactgtcagtcttatgatagcagcaatcattgggtgttcggcggagggaccaagctgaccgtcctaggttct
agaggtggtggtggtagcggcggcggcggctctggtggtggtggatccctcgagatggcccaagtgcagctacagcagtgg
ggcgcaggactgttgaagccttcggagaccctgtccctcacctgcgctgtctatggtgggtccttcagtggttactactggagctg
gatccgccagccccagggaaggggctggagtggattggggagatcactcatagtggaaggtccaactacaacccgtccctc
aagagtcgagtcaccatatcagtagacacgtccaagaaccagttctcccctgaagctgagctctgtgaccgccgcggacacggc
cgtgtattactgtgcgcgctcttctatcatgtctgattactgggtcaaggtactctggtgaccgtctcctcaactagtggccaggcc
ggccagcaccatcaccatcaccatggcgcatacccgtacgacgttccggactacgcttct [SEQ ID NO: 805]

Amino Acid Sequence
NFMLTQPHSVSESPGKTVTISCTGSSGSIASNYVQWYQQRPGSAPTTVIYEDNQR
PSGVPDRFSGSIDSSSNSASLTISGLKTEDEADYYCQSYDSSNHWVFGGGTKLTV
LGSRGGGGSGGGGSGGGGSLEMAQVQLQQWGAGLLKPSETLSLTCAVYGGSFS
GYYWSWIRQPPGKGLEWIGEITHSGRSNYNPSLKSRVTISVDTSKNQFSLKLSSVT
AADTAVYYCARSSIMSDYWGQGTLVTVSSTSGQAGQHHHHHHGAYPYDVPDY
AS [SEQ ID NO: 806]

TABLE 184

ET200-034

DNA Sequence
cagtctgtgttgacgcagccgccctcagtgtctggggccccagggcagagggtcaccatctcctgcactgggagcacctccaa
catcggggcaggttatgatgtacactggtaccagcagcttccaggaacagcccccaaactcctcatcaacaataacaggaatcg
gccctcaggggtccctgaccgattctctggctccaagtctggcacgtcagccaccctgggcatcaccggactccagactgggg
acgaggccgattattactgcgcgaacatggatggcagcctgactggtgcagtgttcggcggagggaccaagctgaccgtccta
ggttctagaggtggtggtggtagcggcggcggcggctctggtggtggtggatccctcgagatggccgaggtccagctggtgc
agtctggggctgaggtgaagaagcctgggtcctcggtgaaggtctcatgcaaggcttctggaggcaccttcagcagctatgcta
tcagctgggtgcgacaggcccctggacaagggcttgagtggatgggagggatcatccctatctttggtacagcaaactacgcac
agaagttccagggcagagtcacgattaccgcggacgaatccacgagcacagcctacatggagctgagcagcctgagatctga
ggacacggccgtgtattactgtgcgcgcggtctgctctggaccattacgatcgttgggtcaaggtactctggtgaccgtctcct
caactagtggccaggccggccagcaccatcaccatcaccatggcgcatacccgtacgacgttccggactacgcttct [SEQ
ID NO: 807]

Amino Acid Sequence
QSVLTQPPSVSGAPGQRVTISCTGSTSNIGAGYDVHWYQQLPGTAPKLLINNNRN
RPSGVPDRFSGSKSGTSATLGITGLQTGDEADYYCGTWDGSLTGAVFGGGTKLT
VLGSRGGGGSGGGGSGGGGSLEMAEVQLVQSGAEVKKPGSSVKVSCKASGGTF
SSYAISWVRQAPGQGLEWMGGIIPIFGTANYAQKFQGRVTITADESTSTAYMELS
SLRSEDTAVYYCARGSALDHYDRWGQGTLVTVSSTSGQAGQHHHHHHGAYPY
DVPDYAS [SEQ ID NO: 808]

TABLE 185

ET200-035

DNA Sequence
aatttatgctgactcagcccactctgtgtcggagtctccggggaagacggtaaccatctcctgcacccgcagcagtggcagca
ttgccagcaactatgtgcagtggtaccagcagcgcccgggcagtgccccaccactgtgatctatgaggataaccaaagaccct
ctggggtccctgatcggttctctggctccatcgacagctcctccaactctgcctccctcaccatctctggactgaagactgaggac
gaggctgactactactgtcagtcttatgatagcaccaattgggtgttcggcggagggaccaagctgaccgtcctaggttctagag
gtggtggtggtagcggcggcggcggctctggtggtggtggatccctcgagatggcccaggtgcagctggtgcagtctggggc
tgaggtgaagaagcctgggtcctcggtgaaggtctcctgcaaggcttctggaggcaccttcagcagctatgctatcagctgggt
gcgacaggcccctggacaagggcttgagtggatgggagggatcatccctatctttggtacagcaaactacgcacagaagttcc
agggcagagtcacgattaccgcggacgaatccacgagcacagcctacatggagctgagcagcctgagatctgaggacactgc
cgtgtattactgtgcgcgctacaactactacttcaacgattactgggtcaaggtactctggtgaccgtctcctcaactagtggcca
ggccggccagcaccatcaccatcaccatggcgcatacccgtacgacgttccggactacgcttct [SEQ ID NO: 809]

Amino Acid Sequence
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSTNWVFGGGTKLTVLG
SRGGGGSGGGGSGGGGSLEMAQVQLVQSGAEVKKPGSSVKVSCKASGGTFSSY

TABLE 185-continued

ET200-035

AISWVRQAPGQGLEWMGGIIPIFGTANYAQKFQGRVTITADESTSTAYMELSSLR
SEDTAVYYCARYNYYFNDYWGQGTLVTVSSTSGQAGQHHHHHGAYPYDVPD
YAS [SEQ ID NO: 810]

TABLE 186

ET200-037

DNA Sequence
tcctatgtgctgactcagccaccctcagtgtcagtggccccaggaaagacggccaggattacctgtgggggaaacaacattgga
agtaaaagtgtgcactggtaccagcagaagccaggccaggcccctgtgctggtcatctattatgatagcgaccggccctcagg
gatccctgagcgattctctggctccaactctgggaacacggccaccctgaccatcagcagggtcgaagcggggatgaggcc
gactattactgtcaggtgtgggatagtagtagtgatcatccttatgtcttcggaactgggaccaaggtcaccgtcctaggttctaga
ggtggtggtggtagcggcggcggcggctctggtggtggtggatccctcgagatggcccagatgcagctggtgcagtctggag
ctgaggtgaagaagcctggggcctcagtgaaggtctcctgcaaggcttctggttacacctttaccagctatggtatcagctgggt
gcgacaggcccctggacaagggcttgagtggatgggatggatcagcgcttacaatggtaacacaaactatgcacagaagtcc
agggcagagtcaccatgaccacagacacatccacgagcacagcctacatggagctgaggagcctgagatctgacgacactgc
cgtgtattactgtgcgcgctctatgttcggtgctcatgattcttgggtcaaggtactctggtgaccgtctcctcaactagtggccag
gccggccagcaccatcaccatcaccatggcgcatacccgtacgacgttccggactacgcttct [SEQ ID NO: 811]

Amino Acid Sequence
SYVLTQPPSVSVAPGKTARITCGGNNIGSKSVHWYQQKPGQAPVLVIYYDSDRPS
GIPERFSGSNSGNTATLTISRVEAGDEADYYCQVWDSSSDHPYVFGTGTKVTVLG
SRGGGGSGGGGSGGGGSLEMAQMQLVQSGAEVKKPGASVKVSCKASGYTFTS
YGISWVRQAPGQGLEWMGWISAYNGNTNYAQKLQGRVTMTTDTSTSTAYMEL
RSLRSDDTAVYYCARSMFGAHDSWGQGTLVTVSSTSGQAGQHHHHHGAYPY
DVPDYAS [SEQ ID NO: 812]

TABLE 187

ET200-038

DNA Sequence
cagtctgtgttgacgcagccgccctcagtgtctggggccccagggcagagggtcaccatctcctgcactgggagcagctccaa
catcggggcaggttttgatgtacactggtaccagcactcttccaggaacagccccaaactcctcatctatgctaacagcaatcgg
ccctcaggggtccctgaccgattctctggctccaagtctggcacctcagcctccctggccatcactgggctcctggctgaggatg
aggctgattattactgccagtcctatgacagcagcctgagtggtggtggttattcggcggagggaccaaggctgaccgtcctaggttc
tagaggtggtggtggtagcggcggcggcggctctggtggtggtggatccctcgagatggcccaggtgcagctggtgcaatctg
gggctgaggtgaagaagcctgggtcctcggtgaaggtctcctgcaaggcttctggaggcaccttcagcagctatgctatcagct
gggtgcgacaggcccctggacaagggcttgagtggatgggagggatcatccctatctttggtacagcaaactacgcacagaag
ttccagggcagagtcacgattaccgcggacgaatccacgagcacagcctacatggagctgagcagcctgagatctgaggaca
ctgccgtgtattactgtgcgcgcggtgcttctttcgaccgtcatgataactgggtcaaggtactctggtgaccgtctcctcaacta
gtggccaggccggccagcaccatcaccatcaccatggcgcatacccgtacgacgttccggactacgcttct [SEQ ID
NO: 813]

Amino Acid Sequence
QSVLTQPPSVSGAPGQRVTISCTGSSSNIGAGFDVHWYQLLPGTAPKLLIYANSN
RPSGVPDRFSGSKSGTSASLAITGLLAEDEADYYCQSYDSSLSGVVFGGGTKLTV
LGSRGGGGSGGGGSGGGGSLEMAQVQLVQSGAEVKKPGSSVKVSCKASGGTFS
SYAISWVRQAPGQGLEWMGGIIPIFGTANYAQKFQGRVTITADESTSTAYMELSS
LRSEDTAVYYCARGASPFDRHDNWGQGTLVTVSSTSGQAGQHHHHHGAYPYD
VPDYAS [SEQ ID NO: 814]

TABLE 188

ET200-039

DNA Sequence
aattttatgctgactcagccccactctgtgtcggagtctccggggaagacggtaaccatctcctgcacccgcagcagtggcagca
ttgccagcaactatgtgcagtggtaccagcagcgcccgggcagttccccaccactgtgatctatgaggataaccaaagaccct
ctggggtccctgatcggttctctggctccatcgacagctcctccaactctgctcctcaccatctctggactgaagactgaggac
gaggctgactactactgtcagtcttatgatagcagcaattgggtgttcggcggagggaccaaggctgaccgtcctaggttctagag
gtggtggtggtagcggcggcggcggctctggtggtggtggatccctcgagatggccgaggtgcagctggtgcagtctgggc
tgaggtgaagaagcctgggtcctcggtgaaggtctcctgcaaggcttctggaggcaccttcagcagctatgctatcagctggt
gcgacaggcccctggacaagggcttgagtggatgggagggatcatccctatctttggtacagcaaactacgcacagaagttcc

TABLE 188-continued

ET200-039 agggcagagtcacgattaccgcggacgaatccacgagcacagcctacatggagctgagcagcctgagatctgaggacacgg
ccgtgtattactgtgcgcgctctaactactactacaacgattactggggtcaaggtactctggtgaccgtctcctcaactagtggcc
aggccggccagcaccatcaccatcaccatggcgcatacccgtacgacgttccggactacgcttct [SEQ ID NO: 815]

Amino Acid Sequence
NFMLTQPHSVSESPGKTVTISCTRSSGSIASNYVQWYQQRPGSSPTTVIYEDNQRP
SGVPDRFSGSIDSSSNSASLTISGLKTEDEADYYCQSYDSSNWVFGGGTKLTVLG
SRGGGGSGGGGSGGGGSLEMAEVQLVQSGAEVKKPGSSVKVSCKASGGTFSSY
AISWVRQAPGQGLEWMGGIIPIFGTANYAQKFQGRVTITADESTSTAYMELSSLR
SEDTAVYYCARSNYYYNDYWGQGTLVTVSSTSGQAGQHHHHHGAYPYDVPD
YAS [SEQ ID NO: 816]

TABLE 189

ET200-040

DNA Sequence
cagtctgtgttgacgcagccgccctcagtgtctggggccccagggcagagggtcaccatctcctgcactgggagcagctccaa
catcggggcaggttatgatgtacactggtaccagcagcttccaggaacagcccccaaactcctcatctatggtaacagcaatcg
gccctcaggggtccctgaccgattctctggctccaagtctggcaacacagcctccctggccatcactgggctccaggctgagga
tgaggctgattattactgccagtcctatgacagcagcctgagtggttatgtcttcggaactgggaccaaggtcaccgtcctaggttc
tagaggtggtggtggtagcggcggcggcggctctggtggtggtggatccctcgagatggcccaggtgcagctggtgcagtct
gggctgaggtgaagaagcctggggcctcagtgaaggtctcctgcaaggtttccggatacacccactgaattatccatgcact
gggtgcgacaggctcctggaaaagggcttgagtggatggggagttttgatcctgaagatggtgaaacaatctacgcacagaagt
tccagggcagagtcaccatgaccgaggacacatctacagacacagcctacatggagctgagcagcctgagatctgaggacac
tgccgtgtattactgtgcgcgctactctggtgtttactacgattggggtcaaggtactctggtgaccgtctcctcaactagtggccag
gccggccagcaccatcaccatcaccatggcgcatacccgtacgacgttccggactacgcttct [SEQ ID NO: 817]

Amino Acid Sequence
QSVLTQPPSVSGAPGQRVTISCTGSSSNIGAGYDVHWYQQLPGTAPKLLIYGNSN
RPSGVPDRFSGSKSGTSASLAITGLQAEDEADYYCQSYDSSLSGYVFGTGTKVTV
LGSRGGGGSGGGGSGGGGSLEMAQVQLVQSGAEVKKPGASVKVSCKVSGYTLT
ELSMHWVRQAPGKGLEWMGGFDPEDGETIYAQKFQGRVTMTEDTSTDTAYME
LSSLRSEDTAVYYCARYSGVYYDWGQGTLVTVSSTSGQAGQHHHHHGAYPY
DVPDYAS [SEQ ID NO: 818]

TABLE 190

ET200-041

DNA Sequence
aattttatgctgactcagccccactctgtgtcggggtctccggggaagacggtaaccatctcctgcaccggcagcagtggcagc
attgccgacaactttgtgcagtggtaccagcagcgcccgggcggtgtccccaccactgtgatctttaatgatgacgaaagaccct
ctggcgtccctgatcggttctctggctccatcgacacctcctccaattctgcctccctcaccatctctggactgaagactgaggacg
aggctgactactactgtcagtcttatgataataataatcgaggggtgttcggcggagggaccaagctgaccgtcctaggttctaga
ggtggtggtggtagcggcggcggcggctctggtggtggtggatccctcgagatggcccaggtccagctggtgcagtctggg
gctgaggtgaagaagcctgggtcctcggtgaaggtctcctgcaaggcttctggaggcaccttcagcagctatgctatcagctggt
gcgacaggcccctggacaagggcttgagtggatgggatggatgaaccctaacagtggtaacacaggctatgcacagaagttc
cagggcagagtcaccatgaccaggaacacctccataagcacagcctacatggagctgagcaacctgagatctgaggacacgg
ccgtgtattactgtgcgcgctactactcttacggttacgattggggtcaaggtactctggtgaccgtctcctcaactagtggccagg
ccggccagcaccatcaccatcaccatggcgcatacccgtacgacgttccggactacgcttct [SEQ ID NO: 819]

Amino Acid Sequence
NFMLTQPHSVSGSPGKTVTISCTGSSGSIADNFVQWYQQRPGGVPTTVIFNDDER
PSGVPDRFSGSIDTSSNSASLTISGLKTEDEADYYCQSYDNNNRGVFGGGTKLTV
LGSRGGGGSGGGGSGGGGSLEMAQVQLVQSGAEVKKPGSSVKVSCKASGGTFS
SYAISWVRQAPGQGLEWMGWMNPNSGNTGYAQKFQGRVTMTRNTSISTAYME
LSNLRSEDTAVYYCARYYSYGYDWGQGTLVTVSSTSGQAGQHHHHHGAYPY
DVPDYAS [SEQ ID NO: 820]

TABLE 191

ET200-042

DNA Sequence
cagtctgtcgtgacgcagccgccctcagtgtctggggccccagggcagacggtcaccatctcctgcactgggggcagctccaa
catcgggacaggttattttgtaaattggtaccagcaggttccaggaaaagccccaaactcctcatcctgggtaacaataatcggc
cctcgggggtccctgaccgactctccggctccacgtccggcacctcagcctccctggccatcactgggctccaggctgaggat
gagggtacttattactgccagtcctatgacagcagcctgagtggttatgtcttcggaactgggaccaaggtcaccgtcctaggttct
agaggtggtggtggtagcggcggcggcggctctggtggtggtggatccctcgagatggcccaggtacagctgcagcagtcag
gtccaggactggtgaagccctcgcagaccctctcactcacctgtggcatctccggggacagtgtctctaccaacagtgttgcttg
gcactggatcaggcagtccccatcgagaggccttgagtggctgggaaggacatactacaggtccaagtggtctaatgactatgg
agtatctgtgaaaagtcgaatcaccatcatcccagacacatccaagaaccagttctccctgcagctgaactctgtgactcccgag
gacacggctgtgtattactgtgcgcgctcttcttcttggtaccagatcttcgattactggggtcaaggtactctggtgaccgtctcctc
aactagtggccaggccggccagcaccatcaccatcaccatggcgcatacccgtacgacgttccggactacgcttct [SEQ
ID NO: 821]

Amino Acid Sequence
QSVVTQPPSVSGAPGQTVTISCTGSSNIGTGYFVNWYQQVPGKAPKLLILGNNN
RPSGVPDRLSGSTSGTSASLAITGLQAEDEGTYYCQSYDSSLSGYVFGTGTKVTV
LGSRGGGGSGGGGSGGGGSLEMAQVQLQQSGPGLVKPSQTLSLTCGISGDSVST
NSVAWHWIRQSPSRGLEWLGRTYYRSKWSNDYGVSVKSRITIIPDTSKNQFSLQL
NSVTPEDTAVYYCARSSSWYQIFDYWGQGTLVTVSSTSGQAGQHHHHHHGAYP
YDVPDYAS [SEQ ID NO: 822]

TABLE 192

ET200-043

DNA Sequence
aattttatgctgactcagccccactctgtgtcggagtctccggggaagacggtaaccatctcctgcaccggcagcagcgacagc
atagccaacaactatgttcagtggtaccagcagcgcccgggcagtgcccccaccaatgtgatctacgaagatgtccaaagacc
ctctggggtccctgatcggttctctgggtccatcgacagctcctccaactctgcctccctcaccatctctggactgaagactgagg
acgaggctgtctactattgtcagtcttatcatagcgacaatcgttgggtgttcggcggcgggaccaaggtgaccgtcctaggttct
agaggtggtggtggtagcggcggcggcggctctggtggtggtggatccctcgagatggcccaggtgcagctggtggagtctg
ggggaggcttggtacagcctggggggtccctgagactctcctgtgcagcctctggattcacctttagcagctatgccatgagctg
ggtccgccaggctcagggaaggggctggagtgggtctcagctattagtggtagtggtggtagcacatactacgcagactccg
tgaagggccggttcaccatctccagagacaattccaagaacacgctgtatctgcaaatgaacagcctgagagccgaggacacg
gccgtatattactgtgcgcgctctggtgcttactgggactactctgtttacgatgaatggggtcaaggtactctggtgaccgtctcct
caactagtggccaggccggccagcaccatcaccatcaccatggcgcatacccgtacgacgttccggactacgcttct [SEQ
ID NO: 823]

Amino Acid Sequence
NFMLTQPHSVSESPGKTVTISCTGSSDSIANNYVQWYQQRPGSAPTNVIYEDVQR
PSGVPDRFSGSIDSSSNSASLTISGLKTEDEAVYYCQSYHSDNRWVFGGGTKLTV
LGSRGGGGSGGGGSGGGGSLEMAQVQLVESGGGLVQPGGSLRLSCAASGFTFSS
YAMSWVRQAPGKGLEWVSAISGSGGSTYYADSVKGRFTISRDNSKNTLYLQMN
SLRAEDTAVYYCARSGAYWDYSVYDEWGQGTLVTVSSTSGQAGQHHHHHHGA
YPYDVPDYAS [SEQ ID NO: 824]

TABLE 193

ET200-044

DNA Sequence
cagtctgtgttgactcagccaccctcagtgtccgtgtccccaggacagacagccaccatcgcctgttctggacataaattgggg
ataaatatgcttcctggtatcagcagaagtcgggccagtcccctgtgttgatcatctatcaggataataagcggccctcagggattc
ctgagcgattctctggctccaactctgggaacacagccactctgaccatcagcgggacccaggctctggatgaggctgactatta
ttgtcaggcgtgggacagtagtactatgtggcattcggcggagggaccaagctgaccgtcctaggttctagaggtggtggtggt
agcggcggcggcggctctggtggtggtggatccctcgagatggcccaggtgcagctgcaggagtccgggcccaggactggtg
aagccttcggagaccctgtccctcacctgcgttgtctctggtggctccatcagcagtagtaactggtggagctgggtccgccagc
ccccagggaaggggctggagtggattgggaaatctatcatagtgggagccccaactacaaccccctcaagagtcgagtc
accatatcagtagacaagtccaagaaccagttctccctgaagctgagctctgtgaccgccgcggacacggccgtgtattactgtg
cgcgcatgactactcatactttcggttacgatgcttgggtcaaggtactctggtgaccgtctcctcaactagtggccaggccggc
cagcaccatcaccatcaccatggcgcatacccgtacgacgttccggactacgcttct [SEQ ID NO: 825]

Amino Acid Sequence
QSVLTQPPSVSVSPGQTATIACSGHKLGDKYASWYQQKSGQSPVLIIYQDNKRPS
GIPERFSGSNSGNTATLTISGTQALDEADYYCQAWDSSTYVAFGGGTKLTVLGSR
GGGGSGGGGSGGGGSLEMAQVQLQESGPGLVKPSETLSLTCVVSGGSISSSNWW

TABLE 193-continued

ET200-044

SWVRQPPGKGLEWIGEIYHSGSPNYNPSLKSRVTISVDKSKNQFSLKLSSVTAAD
TAVYYCARMTTHTFGYDAWGQGTLVTVSSTSGQAGQHHHHHHGAYPYDVPDY
AS [SEQ ID NO: 826]

TABLE 194

ET200-045

DNA Sequence
cagcctgtgctgactcagccaccctcagtgtcagtggccccaggaaagacggccacgattacttgtggggggaaacaacattgg
aagtgaaagtgtgcactggtaccaccagaagccaggccaggccccctgtgttggtcatctatgatgatgccggccggccctcag
ggatccctgagcgattcactggctccaactctggaaacacggccaccctgaccatcagcagggtcgaagccggggatgaggc
cgactattactgtcaggtgtgggacagaaatagtgctcagtttgtcttcggacctgggaccaaggtcaccgtcctaggttctagag
gtggtggtggtagcggcggcggcggctctggtggtggtggatccctcgagatggcccgaggtccagctggtgcagtctggagc
tgaggtgaagaagcctggggcctcagtgaaggtctcctgcaaggcttctggttacacctttaccagctatggtatcagctgggtg
cgacaggcccctggacaagggcttgagtggatggatggatcagcgcttacaatggtaacacaaactatgcacagaagcttcca
gggcagagtcaccatgaccacagacacatccacgagcacagcctacatggagctgaggagcctgagatctgacgacacggc
cgtgtattactgtgcgcgcggtgttcatctggattggtgggtcaaggtactctggtgacgtctcctcaactagtggccaggccg
gccagcaccatcaccatcaccatggcgcatacccgtacgacgttccggactacgcttct [SEQ ID NO: 827]

Amino Acid Sequence
QPVLTQPPSVSVAPGKTATITCGGNNIGSESVHWYHQKPGQAPVLVIYDDAGRPS
GIPERFTGSNSGNTATLTISRVEAGDEADYYCQVWDRNSAQFVFGPGTKVTVLG
SRGGGGSGGGGSGGGGSLEMAEVQLVQSGAEVKKPGASVKVSCKASGYTFTSY
GISWVRQAPGQGLEWMGWISAYNGNTNYAQKLQGRVTMTTDTSTSTAYMELR
SLRSDDTAVYYCARGVHLDWWGQGTLVTVSSTSGQAGQHHHHHHGAYPYDVP
DYAS [SEQ ID NO: 828]

TABLE 195

ET200-069

DNA Sequence
cagtctgtcgtgacgcagccaccctcagcgtctgggaccccgggcagagggtcaccatctcttgttctggaagcagctccaac
atcggaagtaattatgtatactggtaccagcagctcccaggaacggccccccaaactcctcatctatagtaataatcagcggccctc
aggggtccctgaccgattctctggctccaagtctggcacctcagcctccctggccatcagtgggctccggtccgaggatgaggc
tgattattactgtgcagcatgggatgacagcctgagtggttactactggagctggatc
cgccagcccccaggaaggggctggagtggattggggaaatcaatcatagtggaagcaccaactacaacccgtccctcaaga
gtcgagtcaccatatcagtagacacgtccaagaaccagttctccctgaagctgagctctgtgaccgccgccgacacggccgtgt
attactgtgcgcgcctgtacgaaggtggttaccatggttgggggttcttggctgtcttctgattcttggggtcaaggtactctggtgac
cgtctcctcaactagtggccaggccggccagcaccatcaccatcaccatggcgcatacccgtacgacgttccggactacgcttc
t [SEQ ID NO: 829]

Amino Acid Sequence
QSVVTQPPSASGTPGQRVTISCSGSSSNIGSNYVYWYQQLPGTAPKLLIYSNNQRP
SGVPDRFSGSKSGTSASLAISGLRSEDEADYYCAAWDDSLSGYVFGTGTKLTVL
GSRGGGGSGGGGSGGGGSLEMAQVQLQQWGAGLLKPSETLSLTCAVYGGSFSG
YYWSWIRQPPGKGLEWIGEINHSGSTNYNPSLKSRVTISVDTSKNQFSLKLSSVT
AADTAVYYCARLYEGGYHGWGSWLSSDSWGQGTLVTVSSTSGQAGQHHHHH
HGAYPYDVPDYAS [SEQ ID NO: 830]

TABLE 196

ET200-078

DNA Sequence
cagtctgtgttgactcagccaccctcagcgtctgggaccccggggcagagggtcaccatctcttgttctggaagcagctccaaca
tcggaagtaatactgtaaactggtaccagcagctcccaggaacggccccccaaactcctcatctatagtaataatcagcggccctc
aggggtccctgaccgattctctggctccaagtctggcacctcagcctccctggccatcagtgggctccagtctgaggatgaggct
gattattactgtgcagcatgggatgacagcctgaatggttattgggtgttcggcggagggaccaagctgaccgtcctaggttctag
aggtggtggtggtagcggcggcggcggctctggtggtggtggatccctcgagatggcccaggtgcagctacagcagtgggg
cgcaggactgttgaagccttcggagaccctgtccctcacctgcgctgtctatggtgggtccttcagtggttactactggagctgga
tccgccagccccccagggaaggggctggagtggattggggaaatcaatcatagtggaagcaccaactacaacccgtccctcaa TABLE 196-continued

ET200-078

```
gagtcgagtcaccatatcagtagacacgtccaagaaccagttctccctgaagctgagctctgtgaccgccgcggacacggctgt
gtattactgtgcgcgcgaaggggcatttgatgcttttgatatctggggccaagggacaatggtcaccgtctcttcaactagtggcc
aggccggccagcaccatcaccatcaccatggcgcatacccgtacgacgttccggactacgcttct [SEQ ID NO: 831]
```

Amino Acid Sequence
QSVLTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYWVFGGGTKLTV
LGSRGGGSGGGGSGGGGSLEMAQVQLQQWGAGLLKPSETLSLTCAVYGGSFS
GYYWSWIRQPPGKGLEWIGEINHSGSTNYNPSLKSRVTISVDTSKNQFSLKLSSV
TAADTAVYYCAREGAFDAFDIWGQGTMVTVSSTSGQAGQHHHHHHGAYPYDV
PDYAS [SEQ ID NO: 832]

TABLE 197

ET200-079

DNA Sequence
```
tcctatgagctgactcagccaccctcagcgtctgggaccccgggcagagggtcaccatctcttgttctggaagcagctccaac
atcggaagtaattatgtatactggtaccagcagctcccaggaacggcccccaaactcttcatctataggaataatcagcggccctc
aggggtccctgaccgattctctggctccaagtctggcacctcagcctccctggccatcagtgggctccgggtccgaggatgaggc
tgattattactgtgcagcatgggatgacagcctgagtggttatctcttcggaactgggaccaaggtcaccgtcctaggttctagag
gtggtggtggtagcggcggcggcggctctggtggtggtggatccctcgagatggccgaggtgcagctggtggagtctggggga
ggcttggtacagcctggcaggtcccttgagactctcctgtgcagcctctggattcacctttgatgattatgccatgcactgggtccg
gcaagctccagggaagggcctggagtgggtctcaggtattagttggaatagtggtagcataggctatgcggactctgtgaaggg
ccgattcaccatctccagagacaacgccaagaactccctgtatctgcaaatgaacagtctgagagctgaggacacggccttgtat
tactgtgcaaatggcgactccaactactactacggtatggacgtctggggccaagggaccacggtcaccgtctcctcaactagtg
gccaggccggccagcaccatcaccatcaccatggcgcatacccgtacgacgttccggactacgcttct [SEQ ID NO:
833]
```

Amino Acid Sequence
SYELTQPPSASGTPGQRVTISCSGSSSNIGSNYVYWYQQLPGTAPKLFIYRNNQRP
SGVPDRFSGSKSGTSASLAISGLRSEDEADYYCAAWDDSLSGYLFGTGTKVTVL
GSRGGGGSGGGGSGGGGSLEMAEVQLVESGGGLVQPGRSLRLSCAASGFTFDD
YAMHWVRQAPGKGLEWVSGISWNSGSIGYADSVKGRFTISRDNAKNSLYLQMN
SLRAEDTALYYCANGDSNYYYGMDVWGQGTTVTVSSTSGQAGQHHHHHHGA
YPYDVPDYAS [SEQ ID NO: 834]

TABLE 198

ET200-081

DNA Sequence
```
cagtctgccctgactcagcctgcctccgtgtccgggtctcctggacagtcgatcaccatctcctgcactggaaccagcagtgaca
ttggtggttataactatgtctcctggtaccaacaacacccaggcaaagcccccaaactcatgatttatgatgtcagtaatcggccct
caggggtttctaatcgcttctctggctccaagtctggcaacacggcctcctgaccatctctgggctccaggctgaggacgaggc
tgattattactgcatctcatatacacgcacctggaaccctatgtcttcggagtgggaccaaggtcaccgtcctaggttctagag
gtggtggtggtagcggcggcggcggctctggtggtggtggatccctcgagatggccgaggtgcagctggtgcagtctggggga
ggcgtggtacagcctggggggtccctgagactctcctgtgcagcctctggattcacctttgatgattatgccatgcactgggtccg
tcaagctccagggaagggtctggagtgggtctctcttattagtgggatggtggtagcacatactatgcagactctgtgaagggc
cgattcaccatctccagagacaacagcaaaaactccctgtatctgcaaatgaacagtctgagaactgaggacaccgccttgtatt
actgtgcaaaagatcgggcagcagctggctactactactacggtatggacgtctggggccaagggaccacggtcaccgtctcc
tcaactagtggccaggccggccagcaccatcaccatcaccatggcgcatacccgtacgacgttccggactacgcttct [SEQ
ID NO: 835]
```

Amino Acid Sequence
QSALTQPASVSGSPGQSITISCTGTSSDIGGYNYVSWYQQHPGKAPKLMIYDVSN
RPSGVSNRFSGSKSGNTASLTISGLQAEDEADYYCISYTRTWNPYVFGSGTKVTV
LGSRGGGSGGGGSGGGGSLEMAEVQLVQSGGGVVQPGGSLRLSCAASGFTFD
DYAMHWVRQAPGKGLEWVSLISGDGGSTYYADSVKGRFTISRDNSKNSLYLQM
NSLRTEDTALYYCAKDRAAAGYYYYGMDVWGQGTTVTVSSTSGQAGQHHHH
HHGAYPYDVPDYAS [SEQ ID NO: 836]

TABLE 199

ET200-097

DNA Sequence
ctgcctgtgctgactcagccaccctcagtgtccgtgtccccaggacagacagccatcatcacctgctctggagataaattgggggg
aaaaatatgtttcctggtatcagcagaagccaggccagtcccctgtactggtcatcgatcaagataccaggaggccctcagggat
ccctgagcgattctctggctccaactctgggaccacagccactctgaccatcagcgggacccaggctatggatgaggctgacta
ttactgtcaggcgtgggacaggggtgtggtattcggcggagggaccaagctgaccgtcctaggttctagaggtggtggtggtag
cggcggcggcggctctggtggtggtggatccctcgagatggccgaggtgcagctggtggagtctgggggagacttggtacag
cctggcaggtccctgagactctcctgtgcagcctctggattcacctttaatgattatgccatgcactgggtccggcaagctccagg
gaagggcctggagtgggtctcaggtattagttggagtggtaataacataggctatgcggactctgtgaagggccgattcaccatc
tccagagacaacgccaagaactccctgtatctgcaaatgaacagtctgagagctgaggacacggccttgtattactgtgcaaaa
gatagtatacgdiatggcatcacctggggaggttttgactactggggccagggaaccctggtcaccgtctcctcaactagtggcc
aggccggccagcaccatcaccatcaccatggcgcatacccgtacgacgttccggactacgcttct [SEQ ID NO: 837]

Amino Acid Sequence
LPVLTQPPSVSVSPGQTAIITCSGDKLGEKYVSWYQQKPGQSPVLVIDQDTRRPS
GIPERFSGSNSGTTATLTISGTQAMDEADYYCQAWDRGVVFGGGTKLTVLGSRG
GGGSGGGGSGGGGSLEMAEVQLVESGGDLVQPGRSLRLSCAASGFTFNDYAMH
WVRQAPGKGLEWVSGISWSGNNIGYADSVKGRFTISRDNAKNSLYLQMNSLRA
EDTALYYCAKDSIRYGITWGGFDYWGQGTLVTVSSTSGQAGQHHHHHGAYPY
DVPDYAS [SEQ ID NO: 838]

TABLE 200

ET200-098

DNA Sequence
cagcctgtgctgactcagccaccctcggtgtccaagggcttgagacagaccgccacactcacctgcactgggaacagcaacaa
tgttggcaacctaggagtagcttggctgcagcagcaccagggccaccctcccaaactcctatcctacaggaataacaaccggc
cctcagggatctcagagagattatctgcatccaggtcaggaaacacagctccctgaccattactggactccagcctgaggacg
aggctgactattactgctcagcatgggacagtagcctcagtgcttgggtgttcggcggagggaccaagctgaccgtcctaggttc
tagaggtggtggtggtagcggcggcggcggctctggtggtggtggatccctcgagatggccgaggtgcagctggtggagtct
gggggagtcgtggtacagcctgggggtccctgagactctcctgtgcagcctctggattcacctttgatgattatgccatgcactg
ggtccgtcaagctccggggaaggtctcggggtctcttattaattgggatggtggtagcacctactatgcagactctgtga
agggtcgattcaccatctccagagacaacagcaaaaactccctgtatctgcaaatgaacagtctgagagctgaggacacgcct
tgtattactgtgcaaaaggggatgggctgagggcgtttgactactggggccagggaaccctggtcaccgtctcctcaactagtgg
ccaggccggccagcaccatcaccatcaccatggcgcatacccgtacgacgttccggactacgcttct [SEQ ID NO: 839]

Amino Acid Sequence
QPVLTQPPSVSKGLRQTATLTCTGNSNNVGNLGVAWLQQHQGHPPKLLSYRNN
NRPSGISERLSASRSGNTASLTITGLQPEDEADYYCSAWDSSLSAWVFGGGTKLT
VLGSRGGGGSGGGGSGGGGSLEMAEVQLVESGGVVVQPGGSLRLSCAASGFTF
DDYAMHWVRQAPGKGLEWVSLINWDGGSTYYADSVKGRFTISRDNSKNSLYL
QMNSLRAEDTALYYCAKGMGLRAFDYWGQGTLVTVSSTSGQAGQHHHHHG
AYPYDVPDYAS [SEQ ID NO: 840]

TABLE 201

ET200-099

DNA Sequence
cagtctgtgttgactcagccaccctcagcgtctgggaccccgggcagagggtcaccatctcctgttctggaagcagctccaac
atcggaagtaatactgtaaactggtaccagcagctcccaggaacggccccccaaactcctcatctatagtaatgatcagcggccct
caggggtccctgaccgattctctggctccaagtccggcacctcagcctcctggccatcagtgggctccagtctgaggatgagg
ctgattattactgtgcttcatgggatgacagcctgaatggccgttatgtcttcggaactgggaccaaggtcaccgtcctaggttcta
gaggtggtggtggtagcggcggcggcggctctggtggtggtggatccctcgagatggccagctggtacagtctgg
ggctgaggtgaggaagcctggggcctcagtgaaggtttcctgcaagacttctggatacaccttcagttggtatgctatacattggg
tgcgccaggcccccggacaaaggcttgagtggatgggatggatcaacgctggcaatggaaacacaaaatattcacagaaattt
cagggcagagtcagtcttaccaggacacatccgcgagcacagcctacatggagctgagcagcctgagatctgatgacacgg
ctgtgtattactgtgcgagacccgataattatggttcggtggggatgttttttgatatctggggccaagggacaatggtcaccgtct
cttcaactagtggccaggccggccagcaccatcaccatcaccatggcgcatacccgtacgacgttccggactacgcttct
[SEQ ID NO: 841]

Amino Acid Sequence
QSVLTQPPSASGTPGQRVTISCSGSSSNIGSNTVNWYQQLPGTAPKLLIYSNDQRP
SGVPDRFSGSKSGTSASLAISGLQSEDEADYYCASWDDSLNGRYVFGTGTKVTV
LGSRGGGGSGGGGSGGGGSLEMAQVQLVQSGAEVRKPGASVKVSCKTSGYTFS

TABLE 201-continued

ET200-099

WYAIHWVRQAPGQRLEWMGWINAGNGNTKYSQKFQGRVSLTRDTSASTAYME
LSSLRSDDTAVYYCARPDNYGSGGDVFDIWGQGTMVTVSSTSGQAGQHHHHHH
GAYPYDVPDYAS [SEQ ID NO: 842]

TABLE 202

ET200-100

DNA Sequence
aatttatgctgactcagccccactctgtgtcggagtctccggggaagacggtaaccatctcctgcacccgcagcagtggcagca
ttgccagcaactttgtgcagtggtaccagcagcgcccgggcagtgcccccaccccctatgatctatgaggataacaacagacccc
ctggggtccctgatcggttctctgcctccgtcgacagctcctccaactctgcctccctcaccatctctggactgaagactgaggac
gaggctgactactactgtcagtcttatgataccagcaatgtggtattcggcgggggaccaagctgaccgtcctaggttctagag
gtggtggtggtagcggcggcggcggctctggtggtggtggatccctcgagatggccgaggtgcagctggtggagtctgggg
aggcttggtacagcctggagggtccctgagactctcctgtgcagcctctggattcaccttcagtagttatgaaatgaactgggtcc
gccaggctccagggaaggggctggagtgggtttcatacattagtagtagtggtagtaccatatactacgcagactctgtgaagg
gccgattcaccatctccagagacaacgccaagaactcactgtatctgcaaatgaacagcctgagagccgaggacacggctgttt
attactgtgcacgctgggactacggtatgacgtctggggccaagggaccacggtcaccgtctcctcaactagtggccaggcc
ggccagcaccatcaccatcaccatggcgcataccgtacgacgttccggactacgcttct [SEQ ID NO: 843]

Amino Acid Sequence
NFMLTQPHSVSESPGKTVTISCTRSSGSIASNFVQWYQQRPGSAPTPMIYEDNNRP
PGVPDRFSASVDSSSNSASLTISGLKTEDEADYYCQSYDTSNVVFGGGTKLTVLG
SRGGGGSGGGGSGGGGSLEMAEVQLVESGGGLVQPGGSLRLSCAASGFTFSSYE
MNWVRQAPGKGLEWVSYISSSGSTIYYADSVKGRFTISRDNAKNSLYLQMNSLR
AEDTAVYYCARWDYGMDVWGQGTTVTVSSTSGQAGQHHHHHGAYPYDVPD
YAS [SEQ ID NO: 844]

TABLE 204

ET200-102

DNA Sequence
cagtctgtcgtgacgcagccgccctcagtgtctgcggccccaggacagaaggtcaccatctcctgctctggaagcagctccaa
cattgggaataattatgtatcctggtaccagcagctcccaggaacagcccccaaactcctcatttatgacaataataagcgaccct
cagggattcctgaccgattctctggctccaagtctggcacgtcagccaccctgggcatcaccggactccagactggggacgag
gccgattattactgcggaacatgggatagcagcctgagtgcttatgtcttcggaactggaccaaggtcaccgtcctaggttctag
aggtggtggtggtagcggcggcggcggctctggtggtggtggatccctcgagatggcccaggtccagctggtgcagtctggg
gctgaggtgaagaagcctggggcctcagtgaaagtttcctgcaaggcttctggatacaccttcacgaactatgctctgcattgggt
gcgccaggcccccggacaagggcttgagtggatggcatggatcaacggtggcaatggtaacacaaaatattcacagaacttcc
agggcagagtcaccattaccagggacacatccgcgagcacagcctatatggagctgagcagcctgagatctgaagacacggc
tgtgtattactgtgcgaaaccggaggaaacagctggaacaatccactttgactactggggccagggaacccggtcaccgtctc
ctcaactagtggccaggccggccagcaccatcaccatcaccatggcgcataccgtacgacgttccggactacgcttct
[SEQ ID NO: 847]

Amino Acid Sequence
QSVVTQPPSVSAAPGQKVTISCSGSSSNIGNNYVSWYQQLPGTAPKLLIYDNNKR
PSGIPDRFSGSKSGTSATLGITGLQTGDEADYYCGTWDSSLSAYVFGTGTKVTVL
GSRGGGGSGGGGSGGGGSLEMAQVQLVQSGAEVKKPGASVKVSCKASGYTFT
NYALHWVRQAPGQGLEWMAWINGGNGNTKYSQNFQGRVTITRDTSASTAYME
LSSLRSEDTAVYYCAKPEETAGTIHFDYWGQGTPVTVSSTSGQAGQHHHHHG
AYPYDVPDYAS [SEQ ID NO: 848]

TABLE 205

ET200-103

DNA Sequence
caggctgtgctgactcagccccactctgtgtcggagtctccggggaagacggtaaccatctcctgcacccgcagcagtggcag
cattgccagcaactatgtgcagtggtaccagcagcgcccgggcagtgccccaccactgtgatctatgaggataaccaagac
cctctggggtccctgatcggttctctggctccatcgacagctcctccaactctgcctccctcaccatctctggactgaagactgag
gacgaggctgactactactgtcagtcttatgatagcaccatcacggtgttcggcggagggaccaagctgaccgtcctaggttcta
gaggtggtggtggtagcggcggcggcggctctggtggtggtggatccctcgagatggcccaggtccagctggtacagtctgg
ggctgaggtgaagaagcctgggtcctcggtgaaggtctcctgcaaggcttctggaggcaccttcagcagctatgctatcagctg
ggtgcgacaggcccctggacaagggcttgagtggatgggagggatcatccctatctttggtacagcaaactacgcacagaagtt

TABLE 205-continued

ET200-103 ccagggcagagtcacgattaccgcggacgaatccacgagcacagcctacatggagctgagcagcctgagatctgaggacac
ggccgtgtattactgtgcgggggagggttactatgatagtagtggttattccaacggtgatgcttttgatatctggggccaaggga
caatggtcaccgtctcttcaactagtggccaggccggccagcaccatcaccatcaccatggcgcatacccgtacgacgttccgg
actacgcttct [SEQ ID NO: 849]

Amino Acid Sequence
QAVLTQPHSVSESPGKTVTISCTRSSGSIASNYVQWYQQRPGSAPTTVIYEDNQRP
SGVPDRFSGSIDSSSNSASLTISGLKTEDEADYYCQSYDSTITVFGGGTKLTVLGS
RGGGGSGGGGSGGGGSLEMAQVQLVQSGAEVKKPGSSVKVSCKASGGTFSSYA
ISWVRQAPGQGLEWMGGIIPIFGTANYAQKFQGRVTITADESTSTAYMELSSLRS
EDTAVYYCAGEGYYDSSGYSNGDAFDIWGQGTMVTVSSTSGQAGQHHHHHHG
AYPYDVPDYAS [SEQ ID NO: 850]

TABLE 206

ET200-104

DNA Sequence
aattttatgctgactcagcccactctgtgtcggagtctccggggaagacggtaaccatctcctgcacccgcagcagtggcagca
ttgccagcaactatgtgcagtggtaccagcagcgcccgggcagtgccccaccactgtgatctatgaggataaccaaagaccct
ctggggtccctgatcggttctctggctccatcgacagctcctccaactctgcctcctcaccatctctggactgaagactgaggac
gaggctgactactactgtcagtcttatgatagcagcaatgtggtattcggcggagggaccaaggtcaccgtcctaggttctagag
gtggtggtggtagcggcggcggcggctctggtggtggtggatccctcgagatggccgaggtgcagctggtggagtctggggg
aggcttggtacagcctggagggtccctgagactctcctgtgcagcctctggattcacctttcagtagttatgaaatgaactgggtcc
gccaggctccagggaaggggctggagtgggtttcatacattagtagtagtggtagtaccatatactacgcagactctgtgaagg
gccgattcaccatctccagagacaacgccaagaactcactgtatctgcaaatgaacagcctgagagccgaggacacggctgttt
attactgtgcacgctgggactacggtatggacgtctggggccaagggaccacggtcaccgtctcctcaactagtggccaggcc
ggccagcaccatcaccatcaccatggcgcatacccgtacgacgttccggactacgcttct [SEQ ID NO: 851]

Amino Acid Sequence
NFMLTQPHSVSESPGKTVTISCTRSSGSIASNYVQWYQQRPGSAPTTVIYEDNQRP
SGVPDRFSGSIDSSSNSASLTISGLKTEDEADYYCQSYDSSNVVFGGGTKVTVLGS
RGGGGSGGGGSGGGGSLEMAEVQLVESGGGLVQPGGSLRLSCAASGFTFSSYE
MNWVRQAPGKGLEWVSYISSSGSTIYYADSVKGRFTISRDNAKNSLYLQMNSLR
AEDTAVYYCARWDYGMDVWGQGTTVTVSSTSGQAGQHHHHHHGAYPYDVPD
YAS [SEQ ID NO: 852]

TABLE 207

ET200-105

DNA Sequence
tcctatgtgctgactcagccaccctcagtgtccgtgtccccaggacagacagccagcatcacctgctctggagatagattgacga
ataaatatgtttcctggtatcaacagaagccaggccagtcccctgtgttggtcatctatgaggatgccaagcggccctcagggatc
cctgcgcgattctctggctccaactctgggaacacagccactctgaccatcagcgggacccaggctatggatgagtctgaatatt
actgtcaggcgtgggacagcagtgtggttgttttggcggagggaccaagctgaccgtcctaggttctagaggtggtggtggta
gcggcggcggcggctctggtggtggtggatccctcgagatggccgaggtgcagctggtggagtctgggggaggcttggtaca
gcctggcaggtccctgagactctcctgtgcagcctctggatttacctttgatgattatgccatgcactgggtccggcaagctccag
ggaagggcctggagtgggtctcaggtattagtggaatagtggtagtataggctatgcggactctgtgaagggccgattccat
ctccagagacaacgccaagaactccctgtatctgcaaatgaacagtctgagagatgaggacacggccttgtattactgtgcaaaa
gaccgagggggggggagttatcgttaaggatgcttttgatatctggggccaagggacaatggtcaccgtctcttcaactagtggcc
aggccggccagcaccatcaccatcaccatggcgcatacccgtacgacgttccggactacgcttct [SEQ ID NO: 853]

Amino Acid Sequence
SYVLTQPPSVSVSPGQTASITCSGDRLTNKYVSWYQQKPGQSPVLVIYEDAKRPS
GIPARFSGSNSGNTATLTISGTQAMDESEYYCQAWDSSVVVFGGGTKLTVLGSR
GGGGSGGGGSGGGGSLEMAEVQLVESGGGLVQPGRSLRLSCAASGFTFDDYAM
HWVRQAPGKGLEWVSGISWNSGSIGYADSVKGRFTISRDNAKNSLYLQMNSLR
DEDTALYYCAKDRGGGVIVKDAFDIWGQGTMVTVSSTSGQAGQHHHHHHGAY
PYDVPDYAS [SEQ ID NO: 854]

TABLE 208

ET200-106

DNA Sequence
tcctatgagctgactcagccaccgcagcgtctgggaccccggacagagagtcaccatctcttgttctgggggcgtctccaac
atcggggagtggtgtctaaattggtaccagcaactcccaggaacggcccccaaactcctcatctatagttacaatcagcggccct
caggggtctctgaccgattctctggctccaggtctgccacctcagcctcccggccatcagtgggctccagtctgaggatgaggc
tgattattactgtgcaacctgggatgatagtgtgaatggttgggtgttcggcggagggaccaagctgaccgtcctaggttctagag
gtggtggtggtagcggcggcggcggctctggtggtggtggatccctcgagatggccgaggtgcagctggtggagtctggagc
tgaggtgaagaagcctggggattcagtgaaggtctcctgcaaggccttctggttacaattttctcaactatggtatcaactgggtgcg
acaggcccctggacaagggcttgagtggatgggatggattagcacttacaccggtaacacaaactatgcacagaagctgcagg
gcagagtcaccttcaccacagacacatccacgagcacagcctacatggagatgaggagcctgagatctgacgacacggccgt
gtattactgtgcgccagcagggtggtggttggtacgatgtttgggtcaaggtactctggtcaccgtctcctcaactagtggcc
aggccggccagcaccatcaccatcaccatggcgcatacccgtacgacgttccggactacgcttct [SEQ ID NO: 855]

Amino Acid Sequence
SYELTQPPAASGTPGQRVTISCSGGVSNIGSGALNWYQQLPGTAPKLLIYSYNQR
PSGVSDRFSGSRSATSASLAISGLQSEDEADYYCATWDDSVNGWVFGGGTKLTV
LGSRGGGGSGGGGSGGGGSLEMAEVQLVESGAEVKKPGDSVKVSCKPSGYNFL
NYGINWVRQAPGQGLEWMGWISTYTGNTNYAQKLQGRVTFTTDTSTSTAYME
MRSLRSDDTAVYYCARQQGGGWYDVWGQGTLVTVSSTSGQAGQHHHHHGA
YPYDVPDYAS [SEQ ID NO: 856]

TABLE 209

ET200-107

DNA Sequence
cagtctgtcgtgacgcagccgccctcagtgtctgcggccccaggagagaaggtcaccatctcctgctctggaagcaacttcaat
gttggaaataatgatgtatcctggtatcagcaactcccaggtgcagcccccaaactcctcatttatgacaataataagcgaccctca
gggattcctgaccgattctctggctccaagtctggcacgtcagccaccctggcactcaccgggctccacagtgacgacgaggc
cgattattactgcggaacatgggatagcagcctgaatactggggggtcttcggaactgggaccaaggtcaccgtcctaggttct
agaggtggtggtggtagcggcggcggcggctctggtggtggtggatccctcgagatggccgaggtccagctggtgcagtctg
gagctgaggtgaagaagcctggggcctcagtgaaggtctcctgcaaggcttctggttacacctttaccagctatactatcagctg
ggtacgacaggcccctggacaagggcttgagtggatgggatggatcacttacaatggtctcacaaactatgcacagaacct
ccagggcagagtcaccatgactacagacacattcacgaccacagcctacatggagctgaggagcctcagatctgacgacacg
gccgtgtattactgtgtgagagaggggtccccgactacggtgacttcgcgtcctttgactactggggccagggaaccctggtca
ccgtctcctcaactagtggccaggccggccagcaccatcaccatcaccatggcgcatacccgtacgacgttccggactacgctt
ct [SEQ ID NO: 857]

Amino Acid Sequence
QSVVTQPPSVSAAPGEKVTISCSGSNFNVGNNDVSWYQQLPGAAPKLLIYDNNK
RPSGIPDRFSGSKSGTSATLDITGLHSDDEADYYCGTWDSSLNTGGVFGTGTKVT
VLGSRGGGGSGGGGSGGGGSLEMAEVQLVQSGAEVKKPGASVKVSCKASGYTF
TSYTISWVRQAPGQGLEWMGWISTYNGLTNYAQNLQGRVTMTTDTFTTTAYME
LRSLRSDDTAVYYCVREGSPDYGDFASFDYWGQGTLVTVSSTSGQAGQHHHHH
HGAYPYDVPDYAS [SEQ ID NO: 858]

TABLE 210

ET200-108

DNA Sequence
cagtctgtgttgacgcagccgccctcagtgtctgcgccccgggacagaaggtcaccatctcctgctctggaagcagctccaac
attgggaataattatgtatcctggtaccagcagttcccaggaacagcccccaaactcctcatttatgacaataataagcgaccctca
gggatttctgaccgattctctggctccaagtctggcacgtcagccaccctgggcatcgccggactccagactggggacgaggc
cgattattactgcggaacatgggataccagcctgagtggttttatgtcttcggaagtgggaccaaggtcaccgtcctaggttctag
aggtggtggtggtagcggcggcggcggctctggtggtggtggatccctcgagatggccgaggtccagctggtgcagtctggt
gctgaggtgaagaagcctggggcctcagtgaaggtctcctgcaaggcttctggttacaccttaccagctatactatcagctggt
acgacaggcccctggacaagggcttgagtggatgggatggatcagcacttacaatggtctcacaaactatgcacagaacctcc
agggcagagtcaccatgactacagacacattcacgaccacagcctacatggagctgaggagcctcagatctgacgacacggc
cgtgtattactgtgtgagagaggggtccccgactacggtgacttcgcgtcctttgactactggggccagggaaccctggtcacc
gtctcctcaactagtggccaggccggccagcaccatcaccatcaccatggcgcatacccgtacgacgttccggactacgcttct
[SEQ ID NO: 859]

Amino Acid Sequence
QSVLTQPPSVSAPPGQKVTISCSGSSSNIGNNYVSWYQFPGTAPKLLIYDNNKRP
SGISDRFSGSKSGTSATLGIAGLQTGDEADYYCGTWDTSLSGFYVFGSGTKVTVL
GSRGGGGSGGGGSGGGGSLEMAEVQLVQSGAEVKKPGASVKVSCKASGYTFTS TABLE 210-continued

ET200-108

YTISWVRQAPGQGLEWMGWISTYNGLTNYAQNLQGRVTMTTDTFTTTAYMEL
RSLRSDDTAVYYCVREGSPDYGDFASFDYWGQGTLVTVSSTSGQAGQHHHHHH
GAYPYDVPDYAS [SEQ ID NO: 860]

TABLE 211

ET200-109

DNA Sequence
ctgcctgtgctgactcagccaccctcagcgtctgcgaccccgggcagagggtcaccatctcttgttctggaaccacctccaaca
tcggaagtaatactgtacactggtaccagcagctcccagggacgccccaaactcctcatctataataataatcagcggccctc
aggggtccctgaccgattctctggctccaagtctggcacctcagcctcctggccatcagtgggctccggtccgaggatgaggc
tacatattcctgtgcaacatgggatgacagcctgagtggtgtggtcttcggcggagggaccaagctgaccgtcctaggttctaga
ggtggtggtggtagcggcggcggcggctctggtggtggtggatcccctcgagatggccgaggtccagctggtgcagtctgggg
ctgaggtgaagaagcctgggtcctcggtgaaggtctcctgcaaggcttctggaggcaccttcagcagctatgctatcagctgggt
gcgacaggcccctggacaagggcttgagtggatggggaggatcatccctatctttggtacagcaaactacgcacagaagttcc
agggcagagtcacgattaccgcggacgaatccacgagcacagcctacatggagctgagcagcctgagatctgaggacacgg
ccgtgtattactgtgcgagagatcccgcctacggtgactacgagtatgatgcttttgatatctggggccaagggacaatggtcacc
gtctcttcaactagtggccaggccggccagcaccatcaccatcaccatggcgcatacccgtacgacgttccggactacgcttct
[SEQ ID NO: 861]

Amino Acid Sequence
LPVLTQPPSASATPGQRVTISCSGTTSNIGSNTVHWYQQLPGTAPKLLIYNNNQRP
SGVPDRFSGSKSGTSASLAISGLRSEDEATYSCATWDDSLSGVVFGGGTKLTVLG
SRGGGGSGGGGSGGGGSLEMAEVQLVQSGAEVKKPGSSVKVSCKASGGTFSSY
AISWVRQAPGQGLEWMGGIIPIFGTANYAQKFQGRVTITADESTSTAYMELSSLR
SEDTAVYYCARDPAYGDYEYDAFDIWGQGTMVTVSSTSGQAGQHHHHHHGAY
PYDVPDYAS [SEQ ID NO: 862]

TABLE 212

ET200-110

DNA Sequence
cagtctgtgttgacgcagccgccctcagcgtctggggaccccgggcagagggtcaccatctcttgttctggaagcagctccaac
atcggaactaatggtgtaaactggttccagcagttcccaggaacggcccccaaactcctcatctatactaatgatcagcggccctc
aggggtccctgaccgattctctggctccaagtctggcacctcagcctcccctggccatcagtgggctccagtctgcggatgaggct
gattattactgtgcagtgtgggaccacagcctgaatggtccggtgttcggcggagggaccaagctgaccgtcctaggttctaga
ggtggtggtggtagcggcggcggcggctctggtggtggtggatcccctcgagatggcccaggtgcagctggtgcagtctgggg
ctgaggtgaagaagcctgggtcctcggtgaaggtctcctgcaaggcttctggaggcaccttcagcagctatgctatcagctgggt
gcgacaggcccctggacaagggcttgagtggatggggaggatcatccctatctttggtacagcaaactacgcacagaagttcc
agggcagagtcacgattaccgcggacgaatccacgagcacagcctacatggagctgagcagcctgagatctgaggacacgg
ccgtgtattactgtgcgagaggggccggttttgatgcttttgatatctggggccaagggacaatggtcaccgtctcttcaactagtg
gccaggccggccagcaccatcaccatcaccatggcgcatacccgtacgacgttccggactacgcttct [SEQ ID NO:
863]

Amino Acid Sequence
QSVLTQPPSASGTPGQRVTISCSGSSSNIGTNGVNWFQQFPGTAPKLLIYTNDQRP
SGVPDRFSGSKSGTSASLAISGLQSADEADYYCAVWDHSLNGPVFGGGTKLTVL
GSRGGGGSGGGGSGGGGSLEMAQVQLVQSGAEVKKPGSSVKVSCKASGGTFSS
YAISWVRQAPGQGLEWMGGIIPIFGTANYAQKFQGRVTITADESTSTAYMELSSL
RSEDTAVYYCARGAGFDAFDIWGQGTMVTVSSTSGQAGQHHHHHHGAYPYDV
PDYAS [SEQ ID NO: 864]

TABLE 213

ET200-111

DNA Sequence
caggctgtgctgactcagccaccctcagcgtctggggaccccgggcagagggtcaccatctcttgttctggaagcagctccaac
atcggaagtaatactgtaaactggtaccagcagctcccaggaacggcccccaaactcctcatctatagtaataatcagcggccct
caggggtccctgaccgattctctggctccaagtctggcacctcagcctcctggccatcagtgggctccagtctgaggatgaga
ctgattattactgtgcagcatgggatgacagcctgaatggttatgtcttcggaactgggaccaaggtcaccgtcctaggttctaga
ggtggtggtggtagcggcggcggcggctctggtggtggtggatcccctcgagatggcccaggtgcagctacagcagtgggc
gcaggactgttgaagccttcggagaccctgtccctcacctgcgctgtctatggtgggtccttcagtggttactactggagctggat

TABLE 213-continued

ET200-111 ccgccagccccagggaaggggctggagtggattggggaaatcaatcatagtggaagcaccaactacaacccgtccctcaag
agtcgagtcaccatatcagtagacacgtccaagaaccagttctccctgaagctgagctctgtgaccgccgcggacacggctgtg
tattactgtgcgagagaggggctagatgcttttgatatctggggccaagggacaatggtcaccgtctcttcaactagtggccagg
ccggccagcaccatcaccatcaccatggcgcatacccgtacgacgttccggactacgcttct [SEQ ID NO: 865]

Amino Acid Sequence
QAVLTQPPSASGTPGQRVTISCSGSSSNIGSNTVNWYQQLPGTAPKLLIYSNNQRP
SGVPDRFSGSKSGTSASLAISGLQSEDETDYYCAAWDDSLNGYVFGTGTKVTVL
GSRGGGGSGGGGSGGGGSLEMAQVQLQQWGAGLLKPSETLSLTCAVYGGSFSG
YYWSWIRQPPGKGLEWIGEINHSGSTNYNPSLKSRVTISVDTSKNQFSLKLSSVT
AADTAVYYCAREGLDAFDIWGQGTMVTVSSTSGQAGQHHHHHGAYPYDVPD
YAS [SEQ ID NO: 866]

TABLE 214

ET200-112

DNA Sequence
caggctgtgctgactcagccaccctcagcgtctgggaccccgggcagagggtcaccatctcttgttctggaagcagctccaac
atcggaagtaatactgtaaactggtaccagcagctcccaggaacggcccccaaactcctcatgtatagtaatgatcagcggccct
caggggtccctgaccgattctctggctccaagtctggcacctcagcctccctggccatcagtgggctccagtctgaggatgagg
ctgattattattgtgcagcatgggatgacagcctgaatggttatgtcttcgcagctgggaccagctcaccgttttaagttctagagg
tggtggtggtagcggcggcggcggctctggtggtggtggatccctcgagatggcccaggtgcagctacagcagtggggcgc
aggactgttgaagccttcggagaccctgtccctcacctgcgctgtctatggtgggtccttcagtggttactactggagctggatcc
gccagccccagggaaggggctggagtggattggggaaatcaatcatagtggaagcaccaactacaacccgtccctcaagag
tcgagtcaccatatcagtagacacgtccaagaaccagttctccctgaagctgagctctgtgaccgccgcggacacggctgtgtat
tactgtgcgagagaggggctagatgcttttgatatctggggccaagggacaatggtcaccgtctcttcaactagtggccaggccg
gccagcaccatcaccatcaccatggcgcatacccgtacgacgttccggactacgcttct [SEQ ID NO: 867]

Amino Acid Sequence
QAVLTQPPSASGTPGQRVTISCSGSSSNIGSNTVNWYQQLPGTAPKLLMYSNDQR
PSGVPDRFSGSKSGTSASLAISGLQSEDEADYYCAAWDDSLNGYVFAAGTQLTV
LSSRGGGGSGGGGSGGGGSLEMAQVQLQQWGAGLLKPSETLSLTCAVYGGSFS
GYYWSWIRQPPGKGLEWIGEINHSGSTNYNPSLKSRVTISVDTSKNQFSLKLSSV
TAADTAVYYCAREGLDAFDIWGQGTMVTVSSTSGQAGQHHHHHGAYPYDVP
DYAS [SEQ ID NO: 868]

TABLE 215

ET200-113

DNA Sequence
cagtctgtcgtgacgcagccgccctcagtgtctgcggccccaggacagaaggtcaccatctcctgctctggaagcagctccaa
cattgggaataattatgtatcctggtaccagcagctcccaggaacagccccaaactcctcatttatgacaataataagcgaccct
cagggattcctgaccgattctctggctccaagtctggcacgtcagccaccctgggcatcactggactccagactggggacgag
gccgattattactgcgaacatgggatagcagcctgagtgctgcttatgtcttcggaactgggaccaaggtcaccgtcctaggttc
tagaggtggtggtggtagcggcggcggcggctctggtggtggtggatcccctcgagatggcccaggtgcagctacagcagtctg
gagctgaggtgaagaagcctggggcctcagtgaaggtctcctgcaaggcttctggttacagctttaccagctatactatcagctg
ggttcgacaggcccctggacaaggccttgagtggatgggatgggtcagcacttacaatggtctcagaaactatgcacagaacct
ccagggcagagtcaccatgactacagacacactcacgaccacagcctacatggagctgaggagcctcagatctgacgacacg
gccgtgtattattgtgtgagagaggggtccccgactacggtgacttcgcggcctttgactactggggcagggcaccctggtc
accgtctcctcaactagtggccaggccggccagcaccatcaccatcaccatggcgcatacccgtacgacgttccggactacgct
tct [SEQ ID NO: 869]

Amino Acid Sequence
QSVVTQPPSVSAAPGQKVTISCSGSSSNIGNNYVSWYQQLPGTAPKLLIYDNNKR
PSGIPDRFSGSKSGTSATLGITGLQTGDEADYYCGTWDSSLSAAYVFGTGTKVTV
LGSRGGGGSGGGGSGGGGSLEMAQVQLVQSGAEVKKPGASVKVSCKASGYSFT
SYTISWVRQAPGQGLEWMGWVSTYNGLRNYAQNLQGRVTMTTDTLTTTAYME
LRSLRSDDTAVYYCVREGSPDYGDFAAFDYWGQGTLVTVSSTSGQAGQHHHHH
HGAYPYDVPDYAS [SEQ ID NO: 870]

TABLE 216

ET200-114

DNA Sequence
caggctgtgctgactcagccaccctcagcgtctgagaccccgggcagagggtcaccatctcttgttctggaagcaggtccaac
atcggaactaatattgtacactggtaccagcagcgcccaggaatggccccaaactcctcacttatggtagtcggcggccctca
ggggtcccggaccgattctctggctccaagtttggcacctcagcctccctggccatcagtgggctccagtctgaggatgaggct
gattattattgtgcagcatgggatgacagtctgaatggtccggctttcggcggagggaccaagctgaccgtcctaggttctagag
gtggtggtggtagcggcggcggcggctctggtggtggtggatccctcgagatggcccaggtgcagctacagcagtggggcg
caggactgttgaagccttcggagacccctgtccctcacctgcgctgtctatggtgggtccttcagtggttactactggagctggatc
cgccagccccaggggaaggggctggagtggattgggaaatcaatcatagtggaagcaccaactacaacccgtccctcaaga
gtcgagtcaccatatcagtagacacgtccaagaaccagttctccctgaagctgagctctgtgaccgccgcggacacggctgtgt
attactgtgcgagagacggtggggctactttgactactggggccagggaaccctggtcaccgtctcctcaactagtggccagg
ccggccagcaccatcaccatcaccatggcgcatacccgtacgacgttccggactacgcttct [SEQ ID NO: 871]

Amino Acid Sequence
QAVLTQPPSASETPGQRVTISCSGSRSNIGTNIVHWYQQRPGMAPKLLTYGSRRP
SGVPDRFSGSKFGTSASLAISGLQSEDEADYYCAAWDDSLNGPAFGGGTKLTVL
GSRGGGGSGGGGSGGGGSLEMAQVQLQQWGAGLLKPSETLSLTCAVYGGSFSG
YYWSWIRQPPGKGLEWIGEINHSGSTNYNPSLKSRVTISVDTSKNQFSLKLSSVT
AADTAVYYCARDGGGYFDYWGQGTLVTVSSTSGQAGQHHHHHGAYPYDVP
DYAS [SEQ ID NO: 872]

TABLE 217

ET200-115

DNA Sequence
cagtctgtgttgacgcagccgccctcagtgtctggggcccccagggcagagggtcaccatctcctgcactgggagcagctccaa
tatcggggcacgttatgatgtacactggtaccagcaactcccaggaacagccccccgactcctcatctctgctaactacgatcgg
ccctcaggggtccctgaccgattctctggctccaagtctggcacctcagcctccctggccatcactgggctccaggctgaggat
gaggctgattattactgccagtcctatgacagcagtgtgagtgcttgggtgttcggcggagggaccaaggtcaccgtcctaggtt
ctagaggtggtggtggtagcggcggcggcggctctggtggtggtggatccctcgagatggccgaagtgcagctggtgcagtct
ggggctgaagtgaaggagcctgggcctcagtgaaggatctcctgcaggcatctggatacaacttcatcagttattatatgcact
gggtgcggcaggcccctgggcaaggtcttgagtggatgggcaccatcaaccccaggcagtggtgagacagactactcacaga
agttgcagggcagagtcaccatgaccagggacccgtccacgggtacattcgacatggggctgagcagcctgacatctgggga
cacggccgtctattattgtgcgacaggtctcatcagaggagctagcgatgcttttaatatctggggccgggggacaatggtcacc
gtctcttcaactagtggccaggccggccagcaccatcaccatcaccatggcgcatacccgtacgacgttccggactacgcttct
[SEQ ID NO: 873]

Amino Acid Sequence
QSVLTQPPSVSGAPGQRVTISCTGSSSNIGARYDVHWYQQLPGTAPRLLISANYD
RPSGVPDRFSGSKSGTSASLAITGLQAEDEADYYCQSYDSSVSAWVFGGGTKVT
VLGSRGGGGSGGGGSGGGGSLEMAEVQLVQSGAEVKEPGASVRISCQASGYNFI
SYYMHWVRQAPGQGLEWMGTINPGSGETDYSQKLQGRVTMTRDPSTGTFDMG
LSSLTSGDTAVYYCATGLIRGASDAFNIWGRGTMVTVSSTSGQAGQHHHHHG
AYPYDVPDYAS [SEQ ID NO: 874]

TABLE 218

ET200-116

DNA Sequence
cagcctgtgctgactcagccaccctcagtgtccgtgtccccaggacagacggccgccatccctgttctggagataagttgggg
gataaatttgcttcctggtatcagcagaagccaggccagtcccctgtgctggtcatctatcaagatactaagcggccctcagggat
ccctgagcgattctctggctccaactctgggaacacagccactctgaccatcagcgggacccaggctatggatgaggctgacta
ttactgtcagacgtgggccagcggcattgtggtgttcggcggagggaccaagctgaccgtcctaggttctagaggtggtggtgg
tagcggcggcggcggctctggtggtggtggatccctcgagatggccagtgcagctacagcagtggggcaggactgttgaag
ccctcgcagaccctctcactcacctgtgccatctccggggacagtgtctctagcaacagtgctgcttggaactggatcaggc
agtccccatcgagaggccttgagtggctgggaaggacatactacaggtccaagtggtataatgattatgcagtatctgtgaaaag
tcgaataaccatcaacccagacacatccaagaaccagttctccctgcagctgaactctgtgactcccgaggacacggctgtgtat
tactgtgcaagagagcgcagtggctggaagggatttgactactggggccagggaaccctggtcaccgtctcctcaactagtgg
ccaggccggccagcaccatcaccatcaccatggcgcatacccgtacgacgttccggactacgcttct [SEQ ID NO:
875]

Amino Acid Sequence
QPVLTQPPSVSVSPGQTAAIPCSGDKLGDKFASWYQQKPGQSPVLVIYQDTKRPS
GIPERFSGSNSGNTATLTISGTQAMDEADYYCQTWASGIVVFGGGTKLTVLSRG
GGGSGGGGSGGGGSLEMAQVQLQQSGPGLVKPSQTLSLTCAISGDSVSSNSAAW

TABLE 218-continued

ET200-116

NWIRQSPSRGRLEWLGRTYYRSKWYNDYAVSVKSRITINPDTSKNQFSLQLNSVTP
EDTAVYYCARERSGWKGFDYWGQGTLVTVSSTSGQAGQHHHHHHGAYPYDVP
DYAS [SEQ ID NO: 876]

TABLE 219

ET200-117

DNA Sequence
gatgttgtgatgactcagtctccaccctcctgtccgtcacccctggagagccggcctccatcacctgcaggtctagtcagagcct
cctggaaagaaatgcatacaacttactggattggtacctgcagaggccaggacagtctccacagctcctgatctacttgggttcta
atcgggccgccggggtccctgacaggtcagtggcagtggatcaggcagagattttacactgaaaatcagcagagtggagcct
gaggatgttggggtttattactgcatgcaagctctacaagctccgttcacttcggcggagggaccaaggtggagatcaaacgttc
taggtggtggtggtagcggcggcggcgctctggtggtggtggatccctcgagatggccgaagtgcagctggtgcagtct
ggggggaggcttggtacagcctggggggtccctgagactctcctgtgcagcctctggattcacctttagcagctatgccatgagct
gggtccgccaggctccagggaaggggctggagtgggtctcagctattagtggtagtggtagcacatactacgcagactcc
gtgaagggccggttcaccatctccagagacaattccaagaacacgctgtatctgcaaatgaacagcctgagagccgaggacac
ggccgtatattactgtgcgaaatggggcccgtttcaggatgcttttgatatctggggccaagggacaatggtcaccgtctcttcaa
ctagtggccaggccggccagcaccatcaccatcaccatggcgcatacccgtacgacgttccggactacgcttct [SEQ ID
NO: 877]

Amino Acid Sequence
DVVMTQSPPSLSVTPGEPASITCRSSQSLLERNAYNYLDWYLQRPGQSPQLLIYL
GSNRAAGVPDRFSGSGSGRDFTLKISRVEPEDVGVYYCMQALQAPFTFGGGTKV
EIKRSRGGGSGGGGSGGGGSLEMAEVQLVQSGGGLVQPGGSLRLSCAASGFTF
SSYAMSWVRQAPGKGLEWVSAISGSGGSTYYADSVKGRFTISRDNSKNTLYLQ
MNSLRAEDTAVYYCAKWGPFQDAFDIWGQGTMVTVSSTSGQAGQHHHHHG
AYPYDVPDYAS [SEQ ID NO: 878]

TABLE 220

ET200-118

DNA Sequence
caggctgtgctgactcagcctgcctccgtgtctgggtctcctggacagtcgatcaccatctcctgcactggaaccagcagtgacg
ttggtggttataactatgtctcctggtaccaacagcacccgggcaaagcccccaaactcatgatttatgaggtcagtaatcggccc
tcaggggtttctaatcgcttctctggctccaagtctggcaacacggcctcctgaccatctctgggctccaggctgaggacgagg
ctgattattactgcagctcatatacaagcagcagccccttatgtcttcggagcagggaccaaggtcaccgtcctaggttctaga
ggtggtggtggtagcggcggcggcggctctggtggtggtggatccctcgagatggccgaggtgcagctggtggagtctggg
gaggcttggtacagcctggcaggtccctgagactctcctgtgcagcctctggattcacctttgatgattatgccatgcactgggtcc
ggcaagctccagggaaggggctggagtgggtctcaggtattagttggaatagtggtagcataggctatgcctgactctgtgaagg
gccgattcaccatctccagagacaacgccaagaaccctgtatctgcaaatgaacagtctgagagctgaggacacggccttgt
attactgtgcaaaagccaggtggacagcagtggcatcagaccaccactttgactactggggccagggaacgctggtcaccgtct
cctcaactagtggccaggccggccagcaccatcaccatcaccatggcgcatacccgtacgacgttccggactacgcttct
[SEQ ID NO: 879]

Amino Acid Sequence
QAVLTQPASVSGSPGQSITISCTGTSSDVGGYNYVSWYQQHPGKAPKLMIYEVSN
RPSGVSNRFSGSKSGNTASLTISGLQAEDEADYYCSSYTSSSTPYVFGAGTKVTV
LGSRGGGSGGGGSGGGGSLEMAEVQLVESGGGLVQPGRSLRLSCAASGFTFD
DYAMHWVRQAPGKGLEWVSGISWNSGSIGYADSVKGRFTISRDNAKNSLYLQM
NSLRAEDTALYYCAKARWTAVASDHHFDYWGQGTLVTVSSTSGQAGQHHHHH
HGAYPYDVPDYAS [SEQ ID NO: 880]

TABLE 221

ET200-119

DNA Sequence
caggctgtgcttactcagccaccctcagcgtctgggaccccgggcagagggtcaccatctcttgttctggaagcagctccaac
atcggaagtaatactgtaaactggtaccagcagctcccaggaacggcccccaaactcctcatctatagtaataatcagcggccct
cagggggtccctgaccgattctctggctccaagtctggcacctcagcctcctggccatcagtgggctccagtctgaggatgagg
ctgattattactgtgcagcatgggatgacagcctgaatggttatgtcttcggaactgggaccaagctgaccgtcctaggttctaga
ggtggtggtggtagcggcggcggcggctctggtggtggtggatccctcgagatggccgaggtgcagctggtgcagtctggg
ctgaggtgaagaagcctgggtcctcggtgaaggtctcctgcaaggcttctggaggcaccttcagcagctatgctatcagctggt

TABLE 221-continued

ET200-119 gcgacaggcccctggacaagggcttgagtggatgggagggatcatccctatctttggtacagcaaactacgcacagaagttcc
agggcagagtcacgattaccgcggacgaatccacgagcacagcctacatggagctgagcagcctgagatctgaggacacgg
ccgtgtattactgtgcgagagattgggactacatggacgtctggggcaaagggaccacggtcaccgtctcctcaactagtggcc
aggccggccagcaccatcaccatcaccatggcgcatacccgtacgacgttccggactacgcttct [SEQ ID NO: 881]

Amino Acid Sequence
QAVLTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYVFGTGTKLTVL
GSRGGGGSGGGGSGGGGSLEMAEVQLVQSGAEVKKPGSSVKVSCKASGGTFSS
YAISWVRQAPGQGLEWMGGIIPIFGTANYAQKFQGRVTITADESTSTAYMELSSL
RSEDTAVYYCARDWDYMDVWGKGTTVTVSSTSGQAGQHHHHHHGAYPYDVP
DYAS [SEQ ID NO: 882]

TABLE 222

ET200-120

DNA Sequence
tcctatgagctgactcagccaccctcagcgtctgggaccccgggcagagggtcaccatctcttgttctggaagcagctccaac
atcggaagtaatactgtaaactggtaccagcagctcccaggaacggcccccaaactcctcatctatagtaataatcagcggccct
caggggtccctgaccgattctctggctccaagtctggcacctcagcctccctggccatcagtgggctccagtctgaggatgagg
ctgattattactgtgcagcatgggatgacagcctgaatggttatgtcttcggaactgggaccaaggtcaccgtcctaggttctaga
ggtggtggtggtagcggcggcggcggctctggtggtggtggatcccccgagatggccgaggtgcagctggtggagtctggag
ctgaggtgaagaagcctggggcctcagtgaaggtctcctgcaaggcttctggttacacctttaccagctatggtatcagctgggt
gcgacaggcccctggacaagggcttgagtggatgggatggatcagcgcttacaatggtaacacaaactatgcacagaagttcc
agggcagagtcaccatgaccacagacacatccacgagcacagcctacatggagctgaggagcctgagatctgacgacacgg
ccgtgtattactgtgcgagagacctatctcggggagctaacccgcattactactactactacggtatggacgtctggggccaagg
gaccacggtcaccgtctcctcaactagtggccaggccggccagcaccatcaccatcaccatggcgcatacccgtacgacgttc
cggactacgcttct [SEQ ID NO: 883]

Amino Acid Sequence
SYELTQPPSASGTPGQRVTISCSGSSSNIGSNTVNWYQQLPGTAPKLLIYSNNQRP
SGVPDRFSGSKSGTSASLAISGLQSEDEADYYCAAWDDSLNGYVFGTGTKVTVL
GSRGGGGSGGGGSGGGGSLEMAEVQLVESGAEVKKPGASVKVSCKASGYTFTS
YGISWVRQAPGQGLEWMGWISAYNGNTNYAQKLQGRVTMTTDTSTSTAYMEL
RSLRSDDTAVYYCARDLSRGANPHYYYYGMDVWGQGTTVTVSSTSGQAGQH
HHHHHGAYPYDVPDYAS [SEQ ID NO: 884]

TABLE 223

ET200-121

DNA Sequence
cagtctgtgttgacgcagccgccctcagtgtctggggcccccagggcagagggtcaccgtctcctgcactgggagcagatccaa
catcggggcaggatatgatgtacactggtaccagcaacttccaggaacagccccaaactcctcatctatggaaatagtaatcgg
cctcaggggtccctgaccgattctctgggtctaagtctggcacctcagcctccctggtcatcactgggctccaggctgaggatg
ccgctgattattactgccagtcctatgacaacactgtgcgtgaatcacctttatgtcttcggaactgggaccaaggtcaccgtcctag
gttctagaggtggtggtggtagcggcggcggcggctctggtggtggtggatccctcgagatggccgaggtgcagctggtgcag
tctggggctgaggtgaagaagcctggggcctcagtgaaggtctcctgcaaggtttccggatacaccttcactgaattatccatgc
actgggtgcgacaggctcctggaaaagggcttgagtggatgggagggtttgatcctgaagatggtgaaacaatctacgcacaga
agttccagggcagagtcaccatgaccgaggacacatctacagacacagcctacatggagctgagcagcctgagatctgagga
cacggccgtgtattactgtgcaacagagagtaatttagtgtcccggcactactactactacggtatggacgtctggggccaaggg
accacggtcaccgtctcctcaactagtggccaggccggccagcaccatcaccatcaccatggcgcatacccgtacgacgttcc
ggactacgcttct [SEQ ID NO: 885]

Amino Acid Sequence
QSVLTQPPSVSGAPGQRVTVSCTGSRSNIGAGYDVHWYQQLPGTAPKLLIYGNS
NRPPGVPDRFSGSKSGTSASLVITGLQAEDAADYYCQSYDNTVRESPYVFGTGTK
VTVLGSRGGGGSGGGGSGGGGSLEMAEVQLVQSGAEVKKPGASVKVSCKVSG
YTLTELSMHWVRQAPGKGLEWMGGFDPEDGETIYAQKFQGRVTMTEDTSTDTA
YMELSSLRSEDTAVYYCATESNLVSRHYYYYGMDVWGQGTTVTVSSTSGQAG
QHHHHHHGAYPYDVPDYAS [SEQ ID NO: 886]

TABLE 224

ET200-122

DNA Sequence
ctgcctgtgctgactcagccaccctcagcgtctgggaccccgggcagagggtcaccatctcttgttctggaaccagctccaac
atcggaagtaattctgtagactggtaccagcagctcccaggaacggcccccaaactcctcatctatagtaataatcagcggccct
caggggtccctgaccgaatctctggctccaagtctggcacctcagcctccctggccatcagtgggctccagtctgaggatgagg
ctgattattactgtgcagcatgggatgacagcctgaatggttatgtcttcggaactgggaccaaggtcaccgtcctaggttctaga
ggtggtggtggtagcggcggcggcggctctggtggtggtggatcccctcgagatggccgaagtgcagctggtgcagtctgggg
ctgaggtgaagaagcctggggcctcagtgaaggtctcctgcaaggcttctggatacaccttcaccggctactatatgcactgggt
gcgacaggcccctggacaagggcttgagtggatgggatggatcaaccctaacagtggtggcacaaactatgcacagaagtttc
agggcagggtcaccatgaccagggacacgtccatcagcacagcctacatggagctgagcaggctgagatctgacgacacgg
ccgtgtattactgtgcgagagattacggatactatggttcggggagttattcgagcggccccctttactactactacgtatggacg
tctggggccaagggaccacggtcaccgtctcctcaactagtggccaggccggccagcaccatcaccatcaccatggcgcata
cccgtacgacgttccggactacgcttct [SEQ ID NO: 887]

Amino Acid Sequence
LPVLTQPPSASGTPGQRVTISCSGTSSNIGSNSVDWYQQLPGTAPKLLIYSNNQRP
SGVPDRISGSKSGTSASLAISGLQSEDEADYYCAAWDDSLNGYVFGTGTKVTVL
GSRGGGGSGGGGSGGGGSLEMAEVQLVQSGAEVKKPGASVKVSCKASGYTFTG
YYMHWVRQAPGQGLEWMGWINPNSGGTNYAQKFQGRVTMTRDTSISTAYMEL
SRLRSDDTAVYYCARDYGYYGSGSYSSGPLYYYYGMDVWGQGTTVTVSSTSG
QAGQHHHHHHGAYPYDVPDYAS [SEQ ID NO: 888]

TABLE 225

ET200-123

DNA Sequence
caggctgtgctgactcagccaccctcagcgtctgggaccccgggcagagggtcaccatctcttgttctggaagcagctccaac
atcggaagtaatactgtaaactggtaccagcagctcccaggaacggcccccaaactcctcatgtataataatgatcagcggccct
caggggtccctgaccgattctctggctccaagtctggcacctcagcctccctggccatcagtgggctccagtctgaggatgagg
ctgattattactgtgcagcatgggatgacagcctcaatggttatgtcttcggacctgggaccaaggtcaccgtcctaggttctagag
gtggtggtggtagcggcggcggcggctctggtggtggtggatcccctcgagatggccgaggtccagctggtgcagtctggagc
tgaggtgaagaagcctggggcctcagtgaaggtctcctgcaaggcttctggttacacctttaccagctatggtatcagctgggtg
cgacaggcccctggacaagggcttgagtggatgggatggatcagcgcttacaatggtaacacaaactatgcacagaagtcca
gggcagagtcaccatgaccacagacacatccacgagcacagcctacatggagctgaggagcctgagatctgacgacacggc
cgtgtattactgtgcgagagacctatctcggggagctaacccgcattactactactactacggtatggacgtctggggccaaggg
accacggtcaccgtctcctcaactagtggccaggccggccagcaccatcaccatcaccatggcgcataccccgtacgacgttcc
ggactacgcttct [SEQ ID NO: 889]

Amino Acid Sequence
QAVLTQPPSASGTPGQRVTISCSGSSSNIGSNTVNWYQQLPGTAPKLLMYNNDQ
RPSGVPDRFSGSKSGTSASLAISGLQSEDEADYYCAAWDDSLNGYVFGPGTKVT
VLGSRGGGGSGGGGSGGGGSLEMAQVQLVESGAEVKKPGASVKVSCKASGYTF
TSYGISWVRQAPGQGLEWMGWISAYNGNTNYAQKLQGRVTMTTDTSTSTAYM
ELRSLRSDDTAVYYCARDLSRGANPHYYYYYGMDVWGQGTTVTVSSTSGQAG
QHHHHHHGAYPYDVPDYAS [SEQ ID NO: 890]

TABLE 226

ET200-125

DNA Sequence
aattttatgctgactcagccccacgctgtgtcggagtctccggggaagacggtaaccatctcctgcacccgcagcagtggcagt
attgccagcaactatgtgcagtggtaccagcagcgcccgggcagttccccccgcactgtgatttatgaggataatcaaagaccct
ctggggtccctggtcggttctctggctccatcgacagctcctccaactctgcctccctcaccatctctggactgaagactgaggac
gaggctgactactactgtcagtcttatgattccaccagtgtgcttttcggcggagggaccaagctgaccgtcctaggttctagagg
tggtggtggtagcggcggcggcggctctggtggtggtggatcccctcgagatggccgaggtccagctggtgcagtctggggct
gaggtgaagaagccagggtcctcggtgaaggtctcctgcaaggcctcggaggccttcagcagcaattctctcagctgggt
gcgacaggcccctggacaagggcttgagtggatgggaaggatcttccctatcctgggtataaacaaactatgcacagaagttcca
gggcagagtcacgattaccgcggacaaatccacgagcacagtctacatggagctgagcagcctgagatctgaggacacggc
cgtctctattactgtgcgagaggaaactaccaatggtatgatgcttttgatatctggggccaagggacaatggtcaccgtctcttcaac
tagtggccaggccggccagcaccatcaccatcaccatggcgcataccccgtacgacgttccggactacgcttct [SEQ ID NO: 891]

Amino Acid Sequence
NFMLTQPHAVSESPGKTVTISCTRSSGSIASNYVQWYQQRPGSSPRTVIYEDNQR
PSGVPGRFSGSIDSSSNSASLTISGLKTEDEADYYCQSYDSTSVLFGGGTKLTVLG
SRGGGGSGGGGSGGGGSLEMAEVQLVQSGAEVKKPGSSVKVSCKASGGTFSSN TABLE 226-continued

ET200-125

SLSWVRQAPGQGLEWMGRIFPILGITNYAQKFQGRVTITADKSTSTAYMELSSLR
SEDTAVYYCARGNYQWYDAFDIWGQGTMVTVSSTSGQAGQHHHHHHGAYPY
DVPDYAS [SEQ ID NO: 892]

TABLE 227

ET200-005

DNA Sequence
cagcctgtgctgactcagccaccctcagtgtcagtggtcccaggaaagacggccaggattacctgtgggggaaaaaacattgg
aagtaaaagtgtgcactggtaccagcagaagccaggccaggcccctgtggtggtcattatgatagtgaccggccctcag
ggatccctgagcgattctctggctccaactctgggaacacggccaccctgaccatcagcagggtcgaagccgggatgaggc
cgactattactgtcaggtgtgggatagtagtagtgatcatcctatgtcttcggaactgggaccaaggtcaccgtcctaggttctag
aggtggtggtggtagcggcggcggcggctctggtggtggtggatccctcgagatggcccaggtgcagctggtgcagtctgga
gctgaggtgaagaagcctggggcctcagtgaaggtctcctgcaaggcttctggttacaccttaccaactatggtatcagctgggt
gcgacaggcccctggacaagggcttgagtggatgggatggatcaatggtaacacaaactatgcacataagctcc
agggcagagtcaccatgaccacagacacatccacgagcacagccaacatggagctgaggagcctgagacctgacgacactg
ccgtgtattactgtgcgcgctcttacttcggttctcatgattactggggtcaaggtactctggtgaccgtctcctcaactagtggcca
ggccggccagcaccatcaccatcaccatggcgcatacccgtacgacgttccggactacgcttct [SEQ ID NO: 893]

Amino Acid Sequence
QPVLTQPPSVSVVPGKTARITCGGKNIGSKSVHWYQQKPGQAPVVVIHYDSDRP
SGIPERFSGSNSGNTATLTISRVEAGDEADYYCQVWDSSSDHPYVFGTGTKVTVL
GSRGGGGSGGGGSGGGGSLEMAQVQLVQSGAEVKKPGASVKVSCKASGYTFT
NYGISWVRQAPGQGLEWMGWISAYNGNTNYAHKLQGRVTMTTDTSTSTANME
LRSLRPDDTAVYYCARSYFGSHDYWGQGTLVTVSSTSGQAGQHHHHHHGAYP
YDVPDYAS [SEQ ID NO: 894]

TABLE 228

ET200-124

DNA Sequence
tcctatgtgctgactcagccaccctcggtgtcagtggccccaggaaagacggccaggatttcctgtgggggaaacgacattgga
agtaaaagtgttttctggtatcagcagaggccaggccaggcccctgtgttggtcgtctatgatgatagcgaccggccctcaggc
tccctgagcgattctctggcttcaactctgggaacacggccaccctgaccatcagcagggtcgaagccgggatgaggccgac
tattactgtcaagtgtgggatagtagtagtgatcattatgtcttcggaactgggaccaaggtcaccgtcctaggttctagaggtggt
ggtggtagcggcggcggcggctctggtggtggtggatccctcgagatggcccaggtgcagctggtggagtctggggaggc
ttggtacagcctggcaggtccctgagactctcctgtgcagcctctggattcacctttgatgattatgccatgcactgggtccggcaa
gctccagggaagggcctggagtgggtctcaggtattagttggaatagtggtagcataggctatgcggactctgtgaagggccga
ttcaccatctccagagacaacgccaagaactccctgtatctgcaaatgaacagtctgagagctgaggacacggccttgtattact
gtgcaaaagatataacctatgttcggggagttatggtgcttttgatatctggggccaagggacaatggtcaccgtctcttcaacta
gtggccaggccggccagcaccatcaccatcaccatggcgcatacccgtacgacgttccggactacgcttct [SEQ ID
NO: 895]

Amino Acid Sequence
SYVLTQPPSVSVAPGKTARISCGGNDIGSKSVFWYQQRPGQAPVLVVYDDSRP
SGLPERFSGFNSGNTATLTISRVEAGDEADYYCQVWDSSSDHYVFGTGTKVTVL
GSRGGGGSGGGGSGGGGSLEMAQVQLVESGGGLVQPGRSLRLSCAASGFTFDD
YAMHWVRQAPGKGLEWVSGISWNSGSIGYADSVKGRFTISRDNAKNSLYLQMN
SLRAEDTALYYCAKDITYGSGSYGAFDIWGQGTMVTVSSTSGQAGQHHHHHG
AYPYDVPDYAS [SEQ ID NO: 896]

XIII. CDR Sequences of Exemplary Extracellular Antigen-Binding Domains (e.g., scFvs

TABLE 229

| Antibody | V_HCDR1 | V_HCDR2 | V_HCDR3 |
|---|---|---|---|
| ET200-001 | GGSFSGYY [SEQ ID NO: 309] | INHSGST [SEQ ID NO: 310] | AREGPYDGFDS [SEQ ID NO: 311] |
| ET200-002 | GYPFNKYD [SEQ ID NO: 315] | IIPIFRTT [SEQ ID NO: 316] | AREWFYWDI [SEQ ID NO: 317] |

TABLE 229-continued

| | | | |
|---|---|---|---|
| ET200-003 | GFTFSSYG [SEQ ID NO: 321] | ISHDGSNK [SEQ ID NO: 322] | ARSNQWSGYFSFDY [SEQ ID NO: 323] |
| ET200-005 | GYTFTNYG [SEQ ID NO: 326] | ISAYNGNT [SEQ ID NO: 327] | ARSYFGSHDY [SEQ ID NO: 328] |
| ET200-006 | GYTFTTYG [SEQ ID NO: 332] | INTYNGHT [SEQ ID NO: 333] | ARVIYGSGDY [SEQ ID NO: 334] |
| ET200-007 | GYSISSGYF [SEQ ID NO: 335] | IYHSRST [SEQ ID NO: 336] | ARGYGYFDY [SEQ ID NO: 337] |
| ET200-008 | GFTFGDYG [SEQ ID NO: 340] | INWNGGST [SEQ ID NO: 341] | ARSKYNFHVYYDY [SEQ ID NO: 342] |
| ET200-009 | GYTFTSYG [SEQ ID NO: 346] | ISAYNGNT [SEQ ID NO: 327] | ARSSGNMVSWKDM [SEQ ID NO: 347] |
| ET200-010 | GYTFTSYG [SEQ ID NO: 346] | ISAYNGNT [SEQ ID NO: 327] | ARGAVAYHD [SEQ ID NO: 351] |
| ET200-011 | GGTLSSYA [SEQ ID NO: 354] | IIPMFGTA [SEQ ID NO: 355] | ARGVHYASFDH [SEQ ID NO: 356] |
| ET200-012 | GFPFNIFG [SEQ ID NO: 360] | ISGYNGNT [SEQ ID NO: 361] | ARGAYGGMDT [SEQ ID NO: 362] |
| ET200-013 | GYMFTSYG [SEQ ID NO: 366] | ISANNGKT [SEQ ID NO: 367] | ARHIGGSYFDR [SEQ ID NO: 368] |
| ET200-014 | GFTFSSYA [SEQ ID NO: 372] | ISGSDGST [SEQ ID NO: 373] | ARSHEANLVGDW [SEQ ID NO: 374] |
| ET200-015 | GYTFTSYG [SEQ ID NO: 346] | ISAYNGNT [SEQ ID NO: 327] | ARWGGFGAVDH [SEQ ID NO: 376] |
| ET200-016 | GFTFSSYS [SEQ ID NO: 378] | ISSSSSYI [SEQ ID NO: 379] | ARGQGYDY [SEQ ID NO: 380] |
| ET200-017 | GGSFSGYY [SEQ ID NO: 309] | INHSGST [SEQ ID NO: 310] | ARYYPGMDM [SEQ ID NO: 384] |
| ET200-018 | GYTLNELS [SEQ ID NO: 387] | FDPEDGET [SEQ ID NO: 388] | ARGGYGDS [SEQ ID NO: 389] |
| ET200-019 | GGTFSSDA [SEQ ID NO: 393] | TIPMFGTA [SEQ ID NO: 355] | AREGYYYPSAYLGSVLNDIS SVYDE [SEQ ID NO: 394] |
| ET200-020 | GYTFTSYG [SEQ ID NO: 346] | ISAYNGNT [SEQ ID NO: 327] | ARSMTSFDY [SEQ ID NO: 396] |
| ET200-021 | GYTFTSYG [SEQ ID NO: 346] | ISAYNGNT [SEQ ID NO: 327] | ARSVYDLDT [SEQ ID NO: 400] |
| ET200-022 | GFTFDDYA [SEQ ID NO: 403] | ISWNSGSI [SEQ ID NO: 404] | ARYRQVGSAYDS [SEQ ID NO: 405] |
| ET200-023 | GYTFTSYG [SEQ ID NO: 346] | ISAYNGNT [SEQ ID NO: 327] | ARYWGFGVSDR [SEQ ID NO: 408] |
| ET200-024 | GGTFSSYA [SEQ ID NO: 411] | IIPIFGTA [SEQ ID NO: 412] | ARYNYYYDS [SEQ ID NO: 413] |
| ET200-025 | GGTFSSYA [SEQ ID NO: 411] | IIPIFGTA [SEQ ID NO: 412] | ARYWGYDSYDE [SEQ ID NO: 415] |
| ET200-026 | GGTFSSYA [SEQ ID NO: 411] | IIPIFGTA [SEQ ID NO: 412] | ARNNHYYNDY [SEQ ID NO: 349] |
| ET200-027 | GYTFTDYY [SEQ ID NO: 420] | VDPEDGET [SEQ ID NO: 421] | ARYWSYSFDYLYMPEGNDW [SEQ ID NO: 422] |
| ET200-028 | GYNFLNYG [SEQ ID NO: 425] | ISTYTGNT [SEQ ID NO: 426] | ARDLYYYEGVDY [SEQ ID NO: 427] |
| ET200-029 | GFTFSSYA [SEQ ID NO: 372] | ISYDGSNK [SEQ ID NO: 431] | ARSYFTSGFYDY [SEQ ID NO: 432] |

TABLE 229-continued

```
ET200-030  GYTLTELS          FDPEDGET          ARMSSMYYD
           [SEQ ID NO: 436]  [SEQ ID NO: 388]  [SEQ ID NO: 437]

ET200-031  GFTVSDYY          ISGSGNSI          ARSTKFDY
           [SEQ ID NO: 440]  [SEQ ID NO: 441]  [SEQ ID NO: 442]

ET200-032  GYSFTNYW          IYPGDSDT          ARSTGSSHMSDE
           [SEQ ID NO: 444]  [SEQ ID NO: 445]  [SEQ ID NO: 446]

ET200-033  GGSFSGYY          ITHSGRS           ARSSIMSDY
           [SEQ ID NO: 309]  [SEQ ID NO: 450]  [SEQ ID NO: 451]

ET200-034  GGTFSSYA          IIPIFGTA          ARGSALDHYDR
           [SEQ ID NO: 411]  [SEQ ID NO: 412]  [SEQ ID NO: 453]

ET200-035  GGTFSSYA          IIPIFGTA          ARYNYYFNDY
           [SEQ ID NO: 411]  [SEQ ID NO: 412]  [SEQ ID NO: 456]

ET200-037  GYTFTSYG          ISAYNGNT          ARSMFGAHDS
           [SEQ ID NO: 346]  [SEQ ID NO: 327]  [SEQ ID NO: 458]

ET200-038  GGTFSSYA          IIPIFGTA          ARGASFDRHDN
           [SEQ ID NO: 411]  [SEQ ID NO: 412]  [SEQ ID NO: 459]

ET200-039  GGTFSSYA          IIPIFGTA          ARSNYYYNDY
           [SEQ ID NO: 411]  [SEQ ID NO: 412]  [SEQ ID NO: 453]

ET200-040  GYTLTELS          FDPEDGET          ARYSGVYYD
           [SEQ ID NO: 436]  [SEQ ID NO: 388]  [SEQ ID NO: 464]

ET200-041  GGTFSSYA          MNPNSGNT          ARYYSYGYD
           [SEQ ID NO: 411]  [SEQ ID NO: 466]  [SEQ ID NO: 467]

ET200-042  GDSVSTNSVA        TYYRSKWSN         ARSSSWYQIFDY
           [SEQ ID NO: 471]  [SEQ ID NO: 472]  [SEQ ID NO: 473]

ET200-043  GFTFSSYA          ISGSGGST          ARSGAYWDYSVYDE
           [SEQ ID NO: 372]  [SEQ ID NO: 475]  [SEQ ID NO: 476]

ET200-044  GGSISSSNW         IYHSGSP           ARMTTHTFGYDA
           [SEQ ID NO: 480]  [SEQ ID NO: 481]  [SEQ ID NO: 482]

ET200-045  GYTFTSYG          ISAYNGNT          ARGVHLDW
           [SEQ ID NO: 346]  [SEQ ID NO: 327]  [SEQ ID NO: 486]

ET200-069  GGSFSGYY          INHSGST           ARLYEGGYHGWGSWLSSDS
           [SEQ ID NO: 309]  [SEQ ID NO: 310]  [SEQ ID NO: 489]

ET200-078  GGSFSGYY          INHSGST           AREGAFDAFDI
           [SEQ ID NO: 309]  [SEQ ID NO: 310]  [SEQ ID NO: 492]

ET200-079  GFTFDDYA          ISWNSGSI          ANGDSNYYYGMDV
           [SEQ ID NO: 403]  [SEQ ID NO: 404]  [SEQ ID NO: 494]

ET200-081  GFTFDDYA          ISGDGGST          AKDRAAAGYYYYGMDV
           [SEQ ID NO: 403]  [SEQ ID NO: 496]  [SEQ ID NO: 497]

ET200-097  GFTFNDYA          ISWSGNNI          AKDSIRYGITWGGFDY
           [SEQ ID NO: 500]  [SEQ ID NO: 501]  [SEQ ID NO: 502]

ET200-098  GFTFDDYA          INWDGGST          AKGMGLRAFDY
           [SEQ ID NO: 403]  [SEQ ID NO: 506]  [SEQ ID NO: 507]

ET200-099  GYTFSWYA          INAGNGNT          ARPDNYGSGGDVFDI
           [SEQ ID NO: 510]  [SEQ ID NO: 511]  [SEQ ID NO: 512]

ET200-100  GFTFSSYE          ISSSGSTI          ARWDYGMDV
           [SEQ ID NO: 515]  [SEQ ID NO: 516]  [SEQ ID NO: 517]

ET200-101  GYTFTWYA          INAGSGNT          ARPNNYGSGGDVFDI
           [SEQ ID NO: 520]  [SEQ ID NO: 521]  [SEQ ID NO: 522]

ET200-102  GYTFTNYA          INGGNGNT          AKPEETAGTIHFDY
           [SEQ ID NO: 525]  [SEQ ID NO: 526]  [SEQ ID NO: 527]

ET200-103  GGTFSSYA          IIPIFGTA          AGEGYYDSSGYSNGDAFDI
           [SEQ ID NO: 411]  [SEQ ID NO: 412]  [SEQ ID NO: 529]
```

TABLE 229-continued

| Antibody | V_H CDR1 | V_H CDR2 | V_H CDR3 |
|---|---|---|---|
| ET200-104 | GFTFSSYE [SEQ ID NO: 515] | ISSSGSTI [SEQ ID NO: 516] | ARWDYGMDV [SEQ ID NO: 517] |
| ET200-105 | GFTFDDYA [SEQ ID NO: 403] | ISWNSGSI [SEQ ID NO: 404] | AKDRGGGVIVKDAFDI [SEQ ID NO: 532] |
| ET200-106 | GYNFLNYG [SEQ ID NO: 425] | ISTYTGNT [SEQ ID NO: 426] | ARQQGGGWYDV [SEQ ID NO: 536] |
| ET200-107 | GYTFTSYT [SEQ ID NO: 537] | ISTYNGLT [SEQ ID NO: 538] | VREGSPDYGDFASFDY [SEQ ID NO: 539] |
| ET200-108 | GYTFTSYT [SEQ ID NO: 537] | ISTYNGLT [SEQ ID NO: 538] | VREGSPDYGDFASFDY [SEQ ID NO: 539] |
| ET200-109 | GGTFSSYA [SEQ ID NO: 411] | IIPIFGTA [SEQ ID NO: 412] | ARDPAYGDYEYDAFDI [SEQ ID NO: 543] |
| ET200-110 | GGTFSSYA [SEQ ID NO: 411] | IIPIFGTA [SEQ ID NO: 412] | ARGAGFDAFDI [SEQ ID NO: 546] |
| ET200-111 | GGSFSGYY [SEQ ID NO: 309] | INHSGST [SEQ ID NO: 310] | AREGLDAFDI [SEQ ID NO: 550] |
| ET200-112 | GGSFSGYY [SEQ ID NO: 309] | INHSGST [SEQ ID NO: 310] | AREGLDAFDI [SEQ ID NO: 550] |
| ET200-113 | GYSFTSYT [SEQ ID NO: 551] | VSTYNGLR [SEQ ID NO: 552] | VREGSPDYGDFAAFDY [SEQ ID NO: 553] |
| ET200-114 | GGSFSGYY [SEQ ID NO: 309] | INHSGST [SEQ ID NO: 310] | ARDGGGYFDY [SEQ ID NO: 555] |
| ET200-115 | GYNFISYY [SEQ ID NO: 559] | INPGSGET [SEQ ID NO: 560] | ATGLIRGASDAFNI [SEQ ID NO: 561] |
| ET200-116 | GDSVSSNSAA [SEQ ID NO: 565] | TYYRSKWYN [SEQ ID NO: 566] | ARERSGWKGFDY [SEQ ID NO: 567] |
| ET200-117 | GFTFSSYA [SEQ ID NO: 372] | ISGSGGST [SEQ ID NO: 475] | AKWGPFQDAFDI [SEQ ID NO: 570] |
| ET200-118 | GFTFDDYA [SEQ ID NO: 403] | ISWNSGSI [SEQ ID NO: 404] | AKARWTAVASDHHFDY [SEQ ID NO: 574] |
| ET200-119 | GGTFSSYA [SEQ ID NO: 411] | IIPIFGTA [SEQ ID NO: 412] | ARDWDYMDV [SEQ ID NO: 577] |
| ET200-120 | GYTFTSYG [SEQ ID NO: 346] | ISAYNGNT [SEQ ID NO: 327] | ARDLSRGANPHYYYYYGMDV [SEQ ID NO: 578] |
| ET200-121 | GYTLTELS [SEQ ID NO: 436] | FDPEDGET [SEQ ID NO: 388] | ATESNLSRHYYYYGMDV [SEQ ID NO: 579] |
| ET200-122 | GYTFTGYY [SEQ ID NO: 582] | INPNSGGT [SEQ ID NO: 583] | ARDGYYGSGSYSSGPLYYYYGMDV [SEQ ID NO: 584] |
| ET200-123 | GYTFTSYG [SEQ ID NO: 346] | ISAYNGNT [SEQ ID NO: 327] | ARDLSRGANPHYYYYYGMDV [SEQ ID NO: 578] |
| ET200-124 | GFTFDDYA [SEQ ID NO: 403] | ISWNSGSI [SEQ ID NO: 404] | AKDITYGSGSYGAFDI [SEQ ID NO: 587] |
| ET200-125 | GGTFSSNS [SEQ ID NO: 589] | IFPILGIT [SEQ ID NO: 590] | ARGNYQWYDAFDI [SEQ ID NO: 591] |

| Antibody | V_L CDR1 | V_L CDR2 | V_L CDR3 |
|---|---|---|---|
| ET200-001 | SSNIGSNT [SEQ ID NO: 312] | SNN [SEQ ID NO: 313] | AAWDDSLNGYV [SEQ ID NO: 314] |
| ET200-002 | SGSIASNY [SEQ ID NO: 318] | EDN [SEQ ID NO: 319] | QSYDSSNSVV [SEQ ID NO: 320] |
| ET200-003 | KLGTKY [SEQ ID NO: 324] | EDN [SEQ ID NO: 319] | QAWDSDTFVV [SEQ ID NO: 325] |

TABLE 229-continued

```
ET200-005  NIGSKS            YDS               QVWDSSSDHPYV
           [SEQ ID NO: 329]  [SEQ ID NO: 330]  [SEQ ID NO: 331]

ET200-006  NIGSKS            YDS               QVWDSSSDHPYV
           [SEQ ID NO: 329]  [SEQ ID NO: 330]  [SEQ ID NO: 331]

ET200-007  NIGSKT            YDS               QVWDSSSDHRV
           [SEQ ID NO: 338]  [SEQ ID NO: 330]  [SEQ ID NO: 339]

ET200-008  SSDVGGYNY         DVS               SSYTSSSTSKV
           [SEQ ID NO: 343]  [SEQ ID NO: 344]  [SEQ ID NO: 345]

ET200-009  NSNIGSNY          RNN               AAWDDSLSAYV
           [SEQ ID NO: 348]  [SEQ ID NO: 349]  [SEQ ID NO: 350]

ET200-010  SSDVGGYNS         DVS               SSYTSSSTPLV
           [SEQ ID NO: 352]  [SEQ ID NO: 344]  [SEQ ID NO: 353]

ET200-011  SSNISIYD          GNN               GTWDDSLSGGV
           [SEQ ID NO: 357]  [SEQ ID NO: 358]  [SEQ ID NO: 359]

ET200-012  DSNIGNNY          DVK               GTWDSRLDAYV
           [SEQ ID NO: 363]  [SEQ ID NO: 364]  [SEQ ID NO: 365]

ET200-013  TSNIGAGYD         TNN               GTWDSSLSAVV
           [SEQ ID NO: 369]  [SEQ ID NO: 370]  [SEQ ID NO: 371]

ET200-014  NIGSKS            YDS               QVWDSSSDHYV
           [SEQ ID NO: 329]  [SEQ ID NO: 330]  [SEQ ID NO: 375]

ET200-015  NIGSKS            YDS               QVWSDSSSDVV
           [SEQ ID NO: 329]  [SEQ ID NO: 330]  [SEQ ID NO: 377]

ET200-016  SLTDYH            ATN               NSRDSGTDEVL
           [SEQ ID NO: 381]  [SEQ ID NO: 382]  [SEQ ID NO: 383]

ET200-017  NIGSKS            DDS               QVWDSSSDHTV
           [SEQ ID NO: 329]  [SEQ ID NO: 385]  [SEQ ID NO: 386]

ET200-018  SSNIGRNG          NDN               AAWDDSLHGVV
           [SEQ ID NO: 390]  [SEQ ID NO: 391]  [SEQ ID NO: 392]

ET200-019  SGSIASNY          EDN               QSYDSSNSWV
           [SEQ ID NO: 318]  [SEQ ID NO: 319]  [SEQ ID NO: 395]

ET200-020  TSNIGNND          DNN               GTWDSSVSAS
           [SEQ ID NO: 397]  [SEQ ID NO: 398]  [SEQ ID NO: 399]

ET200-021  NSNIGNNY          DNN               GTWNTTVTPGYV
           [SEQ ID NO: 401]  [SEQ ID NO: 398]  [SEQ ID NO: 402]

ET200-022  SSNIGNNY          DNN               GTWDSSLGAPYV
           [SEQ ID NO: 406]  [SEQ ID NO: 398]  [SEQ ID NO: 407]

ET200-023  NIGSKS            ADS               QVWDSSSYHNYV
           [SEQ ID NO: 329]  [SEQ ID NO: 409]  [SEQ ID NO: 410]

ET200-024  SGSIASNY          EDN               QSYDSSNLWV
           [SEQ ID NO: 318]  [SEQ ID NO: 319]  [SEQ ID NO: 414]

ET200-025  QSISSY            AAS               QQSYSTPFT
           [SEQ ID NO: 416]  [SEQ ID NO: 417]  [SEQ ID NO: 418]

ET200-026  SGSIASNY          EDN               QSYDSSNWV
           [SEQ ID NO: 318]  [SEQ ID NO: 319]  [SEQ ID NO: 419]

ET200-027  SSNIGAGYD         GNN               QSYDSSLSDVV
           [SEQ ID NO: 423]  [SEQ ID NO: 358]  [SEQ ID NO: 424]

ET200-028  VSNIGSGA          SYS               ATWDDSVNG
           [SEQ ID NO: 428]  [SEQ ID NO: 429]  [SEQ ID NO: 430]

ET200-029  NIGSES            YDT               QVWDSSRDHVV
           [SEQ ID NO: 433]  [SEQ ID NO: 434]  [SEQ ID NO: 435]

ET200-030  SSNIGAGYD         GNS               QSYDSSLSGSYV
           [SEQ ID NO: 423]  [SEQ ID NO: 438]  [SEQ ID NO: 439]
```

TABLE 229-continued

| | | | |
|---|---|---|---|
| ET200-031 | NIGSKS [SEQ ID NO: 329] | YDS [SEQ ID NO: 330] | QVWDSSSDYV [SEQ ID NO: 443] |
| ET200-032 | SSNVGSYT [SEQ ID NO: 447] | NNN [SEQ ID NO: 448] | AAWDDRLGGYV [SEQ ID NO: 449] |
| ET200-033 | SGSIASNY [SEQ ID NO: 318] | EDN [SEQ ID NO: 319] | QSYDSSNHWV [SEQ ID NO: 452] |
| ET200-034 | TSNIGAGYD [SEQ ID NO: 369] | NNR [SEQ ID NO: 454] | GTWDGSLTGAV [SEQ ID NO: 455] |
| ET200-035 | SGSIASNY [SEQ ID NO: 318] | EDN [SEQ ID NO: 319] | QSYDSTNWV [SEQ ID NO: 457] |
| ET200-037 | NIGSKS [SEQ ID NO: 329] | YDS [SEQ ID NO: 330] | QVWDSSSDHPYV [SEQ ID NO: 331] |
| ET200-038 | SSNIGAGFD [SEQ ID NO: 460] | ANS [SEQ ID NO: 461] | QSYDSSLSGVV [SEQ ID NO: 462] |
| ET200-039 | SGSIASNY [SEQ ID NO: 318] | EDN [SEQ ID NO: 319] | QSYDSSNWV [SEQ ID NO: 419] |
| ET200-040 | SSNIGAGYD [SEQ ID NO: 423] | GNS [SEQ ID NO: 438] | QSYDSSLSGYV [SEQ ID NO: 465] |
| ET200-041 | SGSIADNF [SEQ ID NO: 468] | NDD [SEQ ID NO: 469] | QSYDNNRGV [SEQ ID NO: 470] |
| ET200-042 | SSNIGTGYF [SEQ ID NO: 474] | GNN [SEQ ID NO: 358] | QSYDSSLSGYV [SEQ ID NO: 465] |
| ET200-043 | SDSIANNY [SEQ ID NO: 477] | EDV [SEQ ID NO: 478] | QSYHSDNRWV [SEQ ID NO: 479] |
| ET200-044 | KLGDKY [SEQ ID NO: 483] | QDN [SEQ ID NO: 484] | QAWDSSTYVA [SEQ ID NO: 485] |
| ET200-045 | NIGSES [SEQ ID NO: 433] | DDA [SEQ ID NO: 487] | QVWDRNSAQFV [SEQ ID NO: 488] |
| ET200-069 | SSNIGSNY [SEQ ID NO: 490] | SNN [SEQ ID NO: 313] | AAWDDSLSGYV [SEQ ID NO: 491] |
| ET200-078 | SSNIGSNT [SEQ ID NO: 312] | SNN [SEQ ID NO: 313] | AAWDDSLNGY [SEQ ID NO: 493] |
| ET200-079 | SSNIGSNY [SEQ ID NO: 490] | RNN [SEQ ID NO: 349] | AAWDDSLSGYL [SEQ ID NO: 495] |
| ET200-081 | SSDIGGYNY [SEQ ID NO: 498] | DVS [SEQ ID NO: 344] | ISYTRTWNPYV [SEQ ID NO: 499] |
| ET200-097 | KLGEKY [SEQ ID NO: 503] | QDT [SEQ ID NO: 504] | QAWDRGVV [SEQ ID NO: 505] |
| ET200-098 | SNNVGNLG [SEQ ID NO: 508] | RNN [SEQ ID NO: 349] | SAWDSSLSA [SEQ ID NO: 509] |
| ET200-099 | SSNIGSNT [SEQ ID NO: 312] | SND [SEQ ID NO: 513] | ASWDDSLNGRYV [SEQ ID NO: 514] |
| ET200-100 | SGSIASNF [SEQ ID NO: 518] | EDN [SEQ ID NO: 319] | QSYDTSNVV [SEQ ID NO: 519] |
| ET200-101 | NSNIGSNY [SEQ ID NO: 348] | SSS [SEQ ID NO: 523] | ATWDDSLNA [SEQ ID NO: 524] |
| ET200-102 | SSNIGNNY [SEQ ID NO: 406] | DNN [SEQ ID NO: 398] | GTWDSSLSAYV [SEQ ID NO: 528] |
| ET200-103 | SGSIASNY [SEQ ID NO: 318] | EDN [SEQ ID NO: 319] | QSYDSTITV [SEQ ID NO: 530] |
| ET200-104 | SGSIASNY [SEQ ID NO: 318] | EDN [SEQ ID NO: 319] | QSYDSSNVV [SEQ ID NO: 531] |

TABLE 229-continued

| | | | |
|---|---|---|---|
| ET200-105 | RLTNKY [SEQ ID NO: 533] | EDA [SEQ ID NO: 534] | QAWDSSVVV [SEQ ID NO: 535] |
| ET200-106 | VSNIGSGA [SEQ ID NO: 428] | SYN [SEQ ID NO: 429] | ATWDDSVNG [SEQ ID NO: 430] |
| ET200-107 | NFNVGNND [SEQ ID NO: 540] | DNN [SEQ ID NO: 398] | GTWDSSLNTGGV [SEQ ID NO: 541] |
| ET200-108 | SSNIGNNY [SEQ ID NO: 406] | DNN [SEQ ID NO: 398] | GTWDTSLSGFYV [SEQ ID NO: 542] |
| ET200-109 | TSNIGSNT [SEQ ID NO: 544] | NNN [SEQ ID NO: 448] | ATWDDSLSGVV [SEQ ID NO: 545] |
| ET200-110 | SSNIGTNG [SEQ ID NO: 547] | TND [SEQ ID NO: 548] | AVWDHSLNGPV [SEQ ID NO: 549] |
| ET200-111 | SSNIGSNT [SEQ ID NO: 312] | SNN [SEQ ID NO: 313] | AAWDDSLNGYV [SEQ ID NO: 314] |
| ET200-112 | SSNIGSNT [SEQ ID NO: 312] | SND [SEQ ID NO: 513] | AAWDDSLNGYV [SEQ ID NO: 314] |
| ET200-113 | SSNIGNNY [SEQ ID NO: 406] | DNN [SEQ ID NO: 398] | GTWDSSLSAAYV [SEQ ID NO: 554] |
| ET200-114 | RSNIGTNI [SEQ ID NO: 556] | GS [SEQ ID NO: 557] | AAWDDSLNGPA [SEQ ID NO: 558] |
| ET200-115 | SSNIGARYD [SEQ ID NO: 562] | ANY [SEQ ID NO: 563] | QSYDSSVSAWV [SEQ ID NO: 564] |
| ET200-116 | KLGDKF [SEQ ID NO: 568] | QDT [SEQ ID NO: 504] | QTWASGIVV [SEQ ID NO: 569] |
| ET200-117 | QSLLERNAYNY [SEQ ID NO: 571] | LGS [SEQ ID NO: 572] | MQALQAPFT [SEQ ID NO: 573] |
| ET200-118 | SSDVGGYNY [SEQ ID NO: 343] | EVS [SEQ ID NO: 575] | SSYTSSSTPYV [SEQ ID NO: 576] |
| ET200-119 | SSNIGSNT [SEQ ID NO: 312] | SNN [SEQ ID NO: 313] | AAWDDSLNGYV [SEQ ID NO: 314] |
| ET200-120 | SSNIGSNT [SEQ ID NO: 312] | SNN [SEQ ID NO: 313] | AAWDDSLNGYV [SEQ ID NO: 314] |
| ET200-121 | RSNIGAGYD [SEQ ID NO: 580] | GNS [SEQ ID NO: 436] | QSYDNTVRESPYV [SEQ ID NO: 581] |
| ET200-122 | SSNIGSNS [SEQ ID NO: 585] | SNN [SEQ ID NO: 313] | AAWDDSLNGYV [SEQ ID NO: 314] |
| ET200-123 | SSNIGSNT [SEQ ID NO: 312] | NND [SEQ ID NO: 586] | AAWDDSLNGYV [SEQ ID NO: 314] |
| ET200-124 | DIGSKS [SEQ ID NO: 588] | DDS [SEQ ID NO: 385] | QVWDSSSDHYV [SEQ ID NO: 375] |
| ET200-125 | SGSIASNY [SEQ ID NO: 318] | EDN [SEQ ID NO: 319] | QSYDSTSVL [SEQ ID NO: 592] |

TABLE 230

| CDR | CDR SEQUENCE | SEQ ID NO |
|---|---|---|
| $V_H$CDR1 | IFGLH | SEQ ID NO: 923 |
| $V_H$CDR2 | YISGDSNTIYYADTVKG | SEQ ID NO: 924 |
| $V_H$CDR3 | NSYYALDY | SEQ ID NO: 925 |
| $V_L$CDR1 | RASSSVSSSYLH | SEQ ID NO: 926 |
| $V_L$CDR2 | STSNLAS | SEQ ID NO: 927 |
| $V_L$CDR3 | QQYSGYPWT | SEQ ID NO: 928 |
| $V_H$CDR1 | SFGMH | SEQ ID NO: 929 |
| $V_H$CDR2 | YISSGSNNIYFADTVKG | SEQ ID NO: 930 |
| $V_H$CDR3 | SEYYGSSHMDY | SEQ ID NO: 931 |

TABLE 230-continued

| CDR | CDR SEQUENCE | SEQ ID NO |
|---|---|---|
| V$_L$CDR1 | KASQNVGTNVA | SEQ ID NO: 932 |
| V$_L$CDR2 | SATYRNS | SEQ ID NO: 933 |
| V$_L$CDR3 | QQYNRYPYT | SEQ ID NO: 934 |

EXAMPLES

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

Example 1—FcRL5 Expression in Various Tissues

The expression of human FcRL5 was assessed and evaluated in various tissues. As shown in FIG. 1, human FcRL5 was highly expressed in lymphoma and multiple myeloma, but not in other tissues. Top panel of FIG. 1 shows differential expression of human FcRL5 in tumor cell lines from the Cancer Cell Line Encyclopedia (CCLE). The bottom panel of FIG. 1 shows differential expression of human FcRL5 in normal tissue from BioGPS. As shown in FIG. 1, human FcRL5 expression is limited to MM and lymphoma compared to other malignant cells. Normal expression appeared limited to B-cells and plasma cells. Potential FcRL5 targeted CAR T cell eradication of these normal cell types may not have significant adverse effects based on inventors' patient experience with CD19 targeted CAR T cells. Any lack of physiologic antibody production can be addressed with intravenous immunoglobulin treatment.

Figure 2:
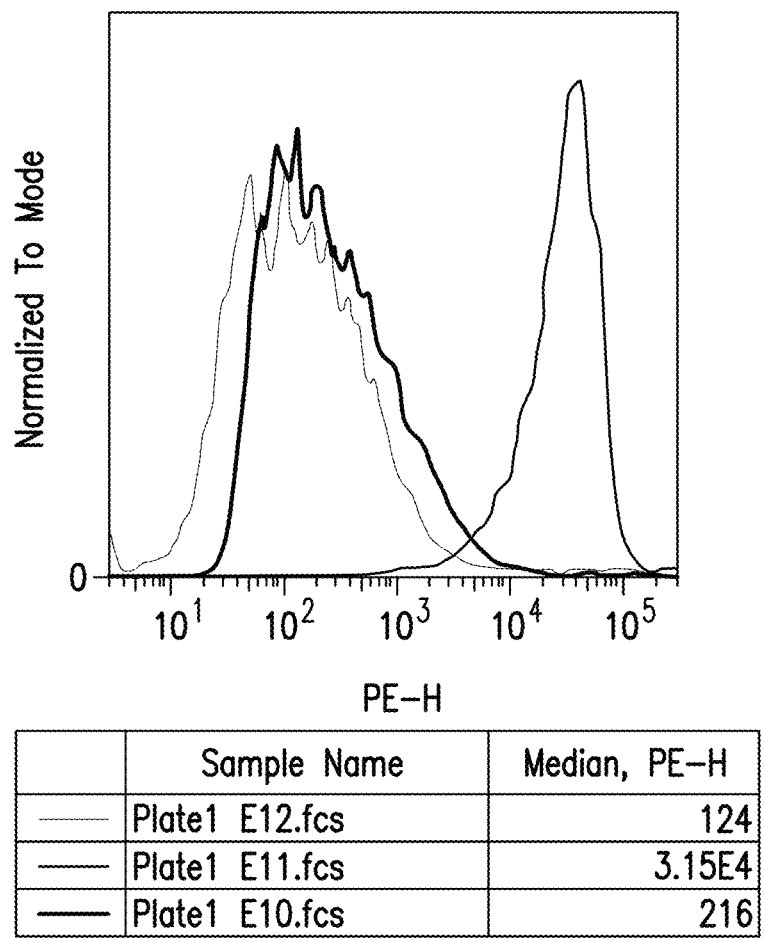
FIG. 2 depicts the screening of anti-FcRL5 scFvs using 3T3 cells expressing FcRL5 or FcRL1, 2, 3, 4 or 6.

Example 2—Selection of ScFv Specific for FcRL5 Using a Fully Human Phage Display Library Phage display selection against FcRL5 was conducted using a cell panning strategy with 31 human scFv naïve and semi-synthetic phage sub-libraries. FcRL5 overexpressing 3T3 cells were used in positive panning, FcRL1, 2, 3, 4 and 6 overexpressing 3T3 cells (5 cell lines in total) were used in negative panning (FIG. 2). Bound clones were then eluted and used to infect E. Coli XL1-Blue. The scFv phage clones expressed in the bacteria were purified as previously described (Yasmina, et al. Probing the binding mechanism and affinity of tanezumab, a recombinant humanized anti-NGF monoclonal antibody, using a repertoire of biosensors. Protein Science 2008, 17(8):1326-1335; Roberts, et al. Vaccination with CD20 peptides induces a biologically active, specific immune response in mice. Blood 2002, 99(10): 3748-3755). Panning was performed for about 3 to about 4 cycles to enrich scFv phage clones that bind to FcRL5 specifically. Positive clones were determined by an ELISA method against His-tag FcRL5.

Positive clones were further tested for their binding to FcRL5 on live cell surfaces by flow cytometry, using FcRL5-overexpressing cell lines, 3T3 and Raji. The cells were then washed, and the staining was performed using the following steps: the cells can be first stained with purified scFv phage clones, and followed by staining with a mouse anti-M13 mAb, and finally the horse anti-mouse Ig's conjugate to PE. Each step of the staining was completed between 30-60 minutes on ice and the cells were washed twice between each step of the staining.

76 unique clones that were specific for FcRL5 were identified and confirmed by screening (see Tables 1-229 and FIG. 2).

Example 3—Selection of ScFv Specific for Domain 9 of FcRL5

FcRL5 contains 9 extracellular immunoglobulin-like domains (domains 1-9) and can be present within a cell in a soluble isoform, a glycosyl-phosphotidyl inositol (GPI)-anchor type isoform and a transmembrane-type isoform (FIG. 3A). As shown in FIG. 2A, the transmembrane-type isoform of FcRL5 has domain 9; whereas, the soluble isoform and the GPI-anchor type isoform do not.

Figure 4:
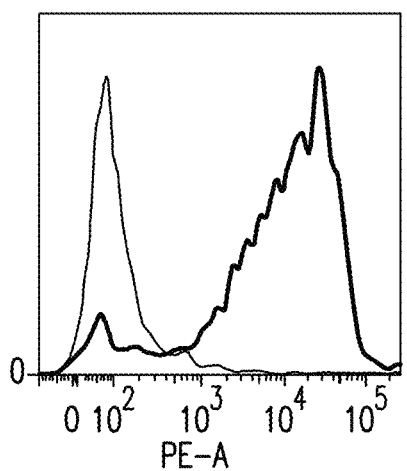
FIG. 4 depicts the screening of anti-FcRL5 scFv ET200-39 on 3T3 cells expressing FcRL5Δdom9.
Figure 4:
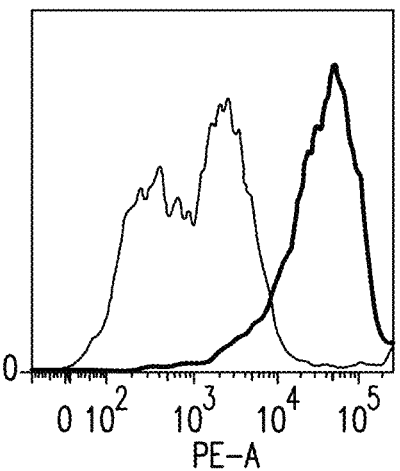
Figure 4:
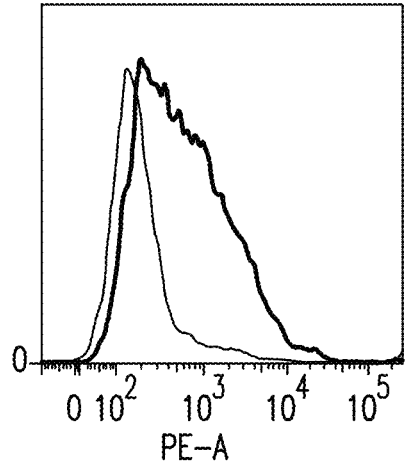
Figure 4:
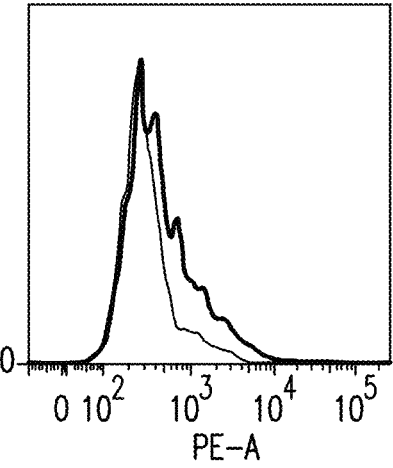
Figure 5:
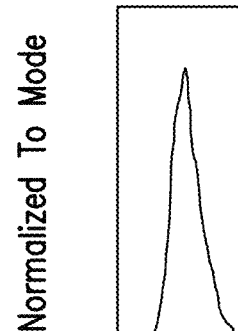
FIG. 5 depicts the screening of anti-FcRL5 scFv ET200-104 on 3T3 cells expressing FcRL5Δdom9.
Figure 5:
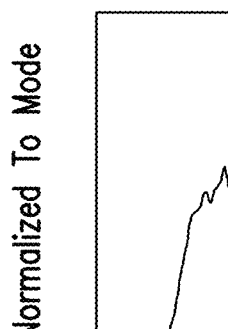
Figure 5:
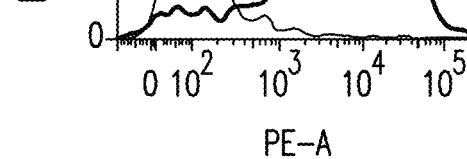
Figure 5:
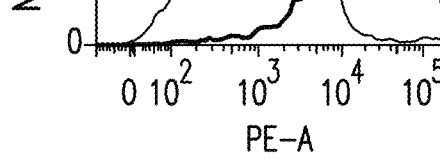
Figure 5:
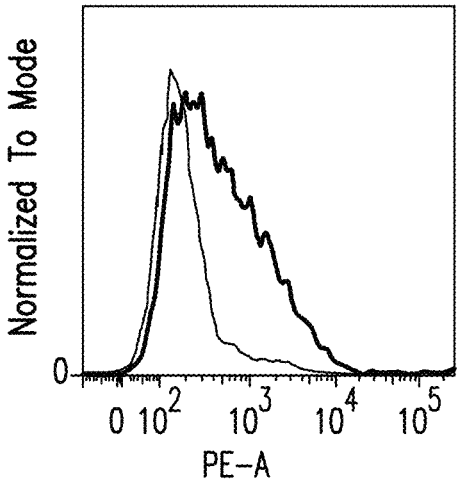
Figure 5:
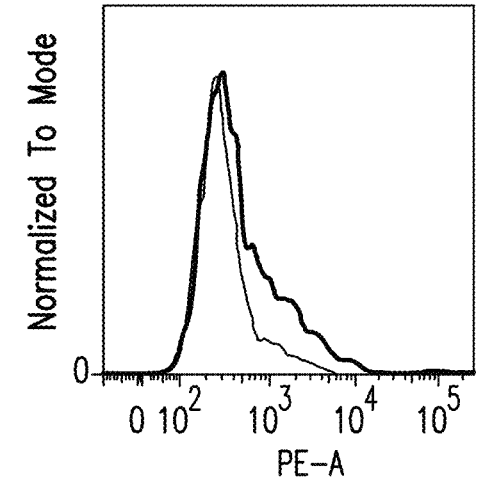
Figure 6:
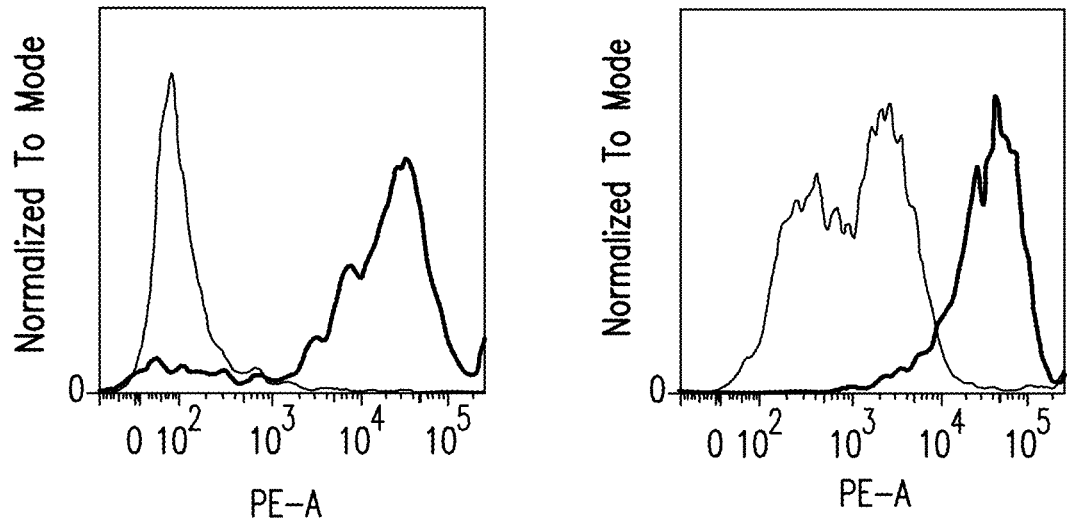
FIG. 6 depicts the screening of anti-FcRL5 scFv ET200-105 on 3T3 cells expressing FcRL5Δdom9.
Figure 6:
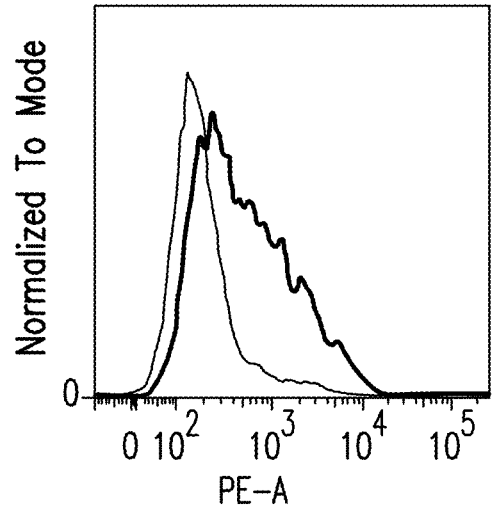
Figure 6:
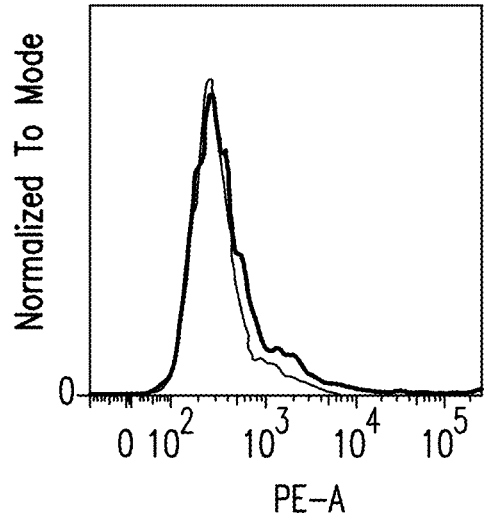
Figure 6:
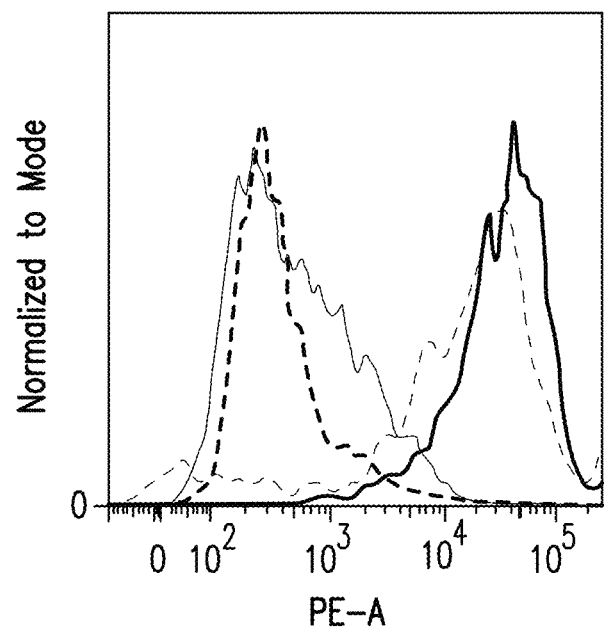
Figure 7:
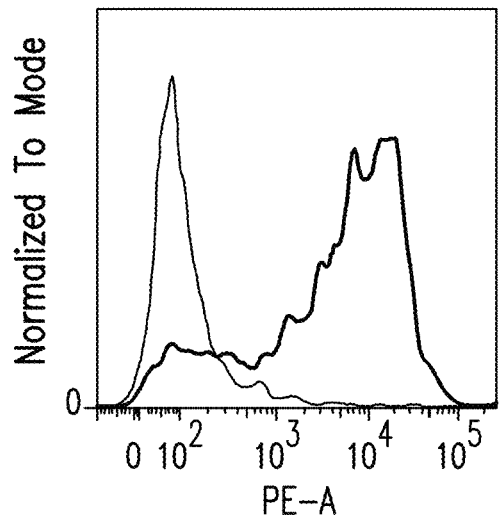
FIG. 7 depicts the screening of anti-FcRL5 scFv ET200-109 on 3T3 cells expressing FcRL5Δdom9.
Figure 7:
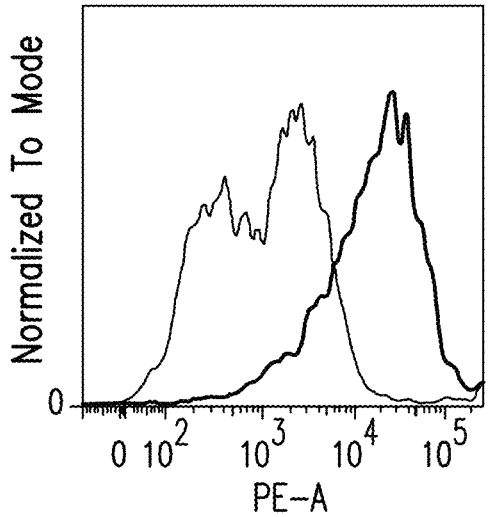
Figure 7:
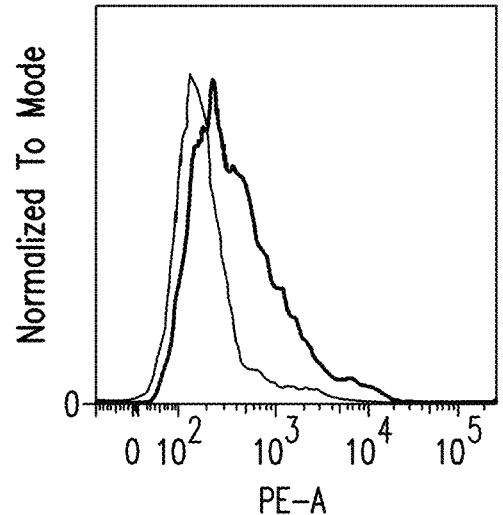
Figure 7:
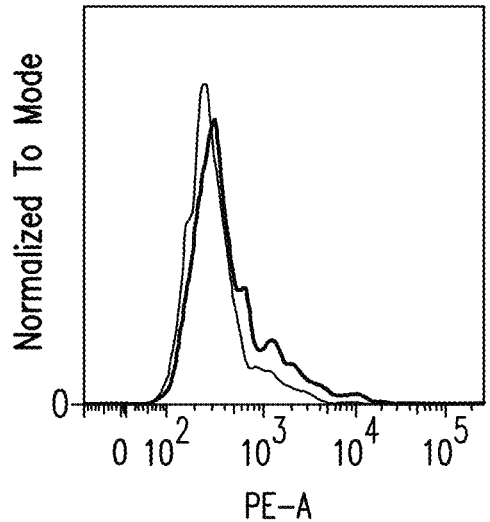
Figure 8:
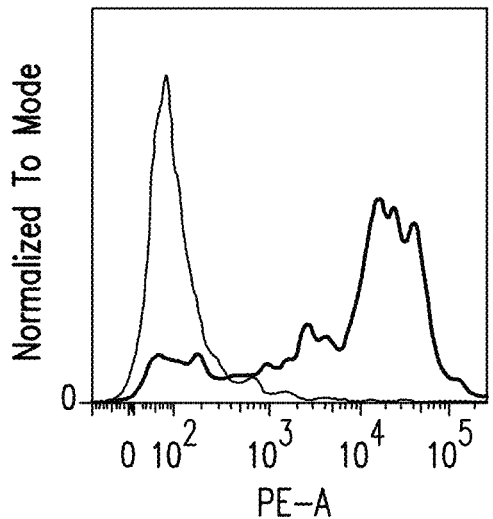
FIG. 8 depicts the screening of anti-FcRL5 scFv ET200-117 on 3T3 cells expressing FcRL5Δdom9.
Figure 8:
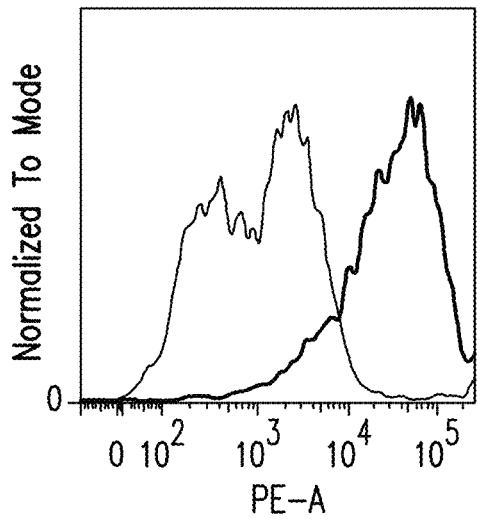
Figure 8:
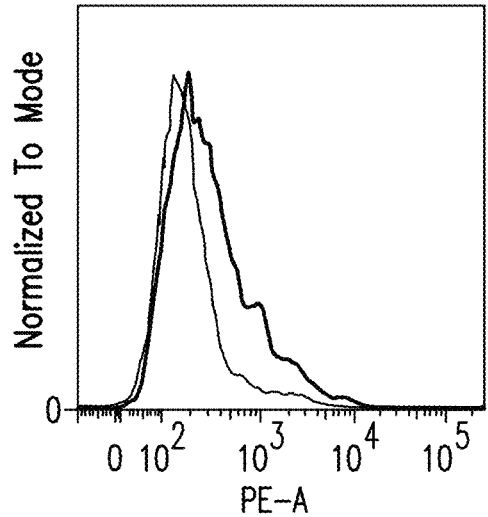
Figure 8:
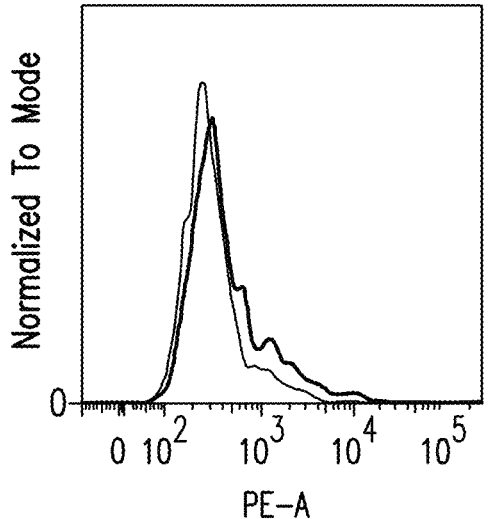
Figure 10:
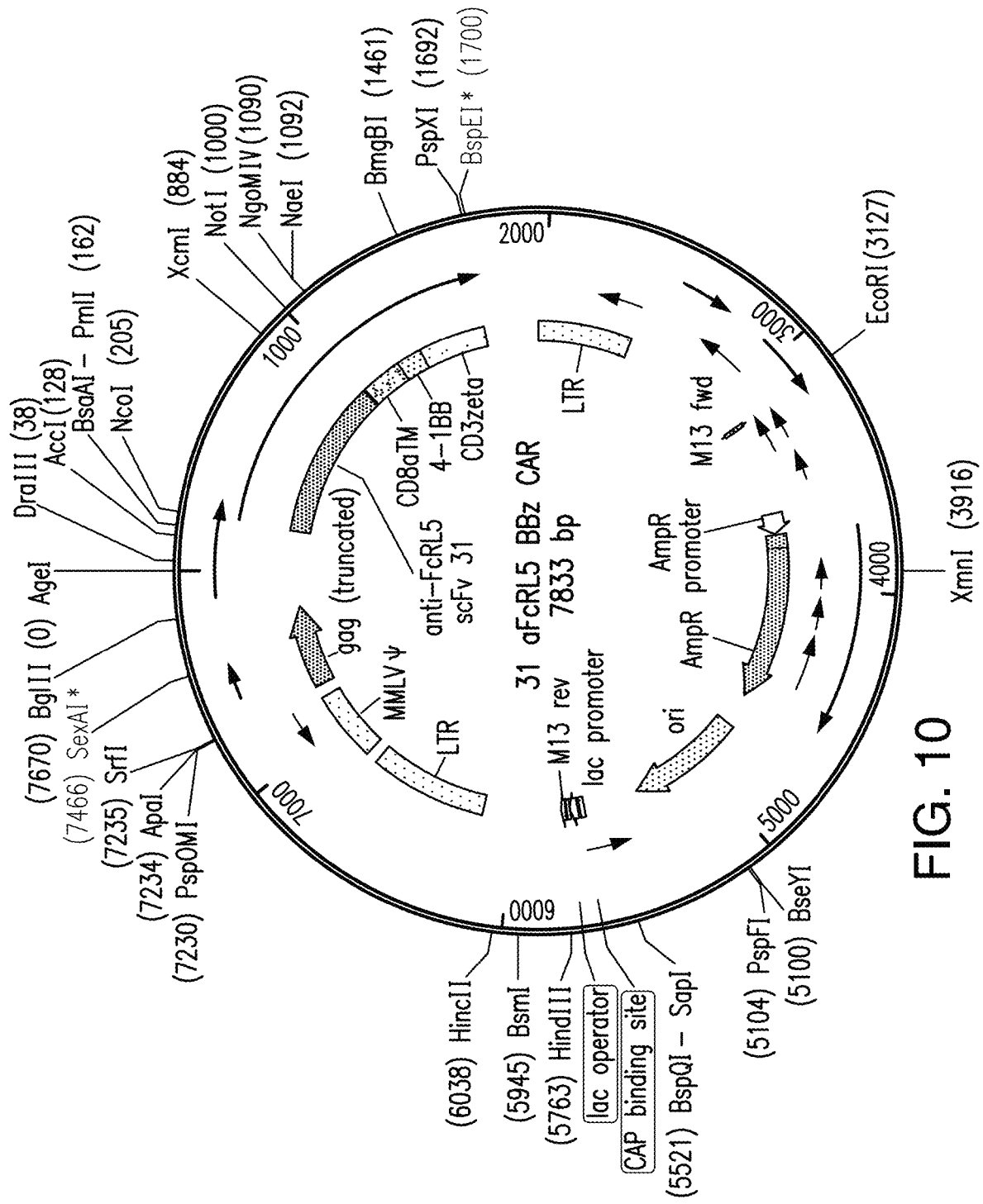
FIG. 10 depicts the vector map of a chimeric antigen receptor targeting FcRL5 using scFV ET200-31 in accordance with one non-limiting embodiment of the presently disclosed subject matter.
Figure 11:
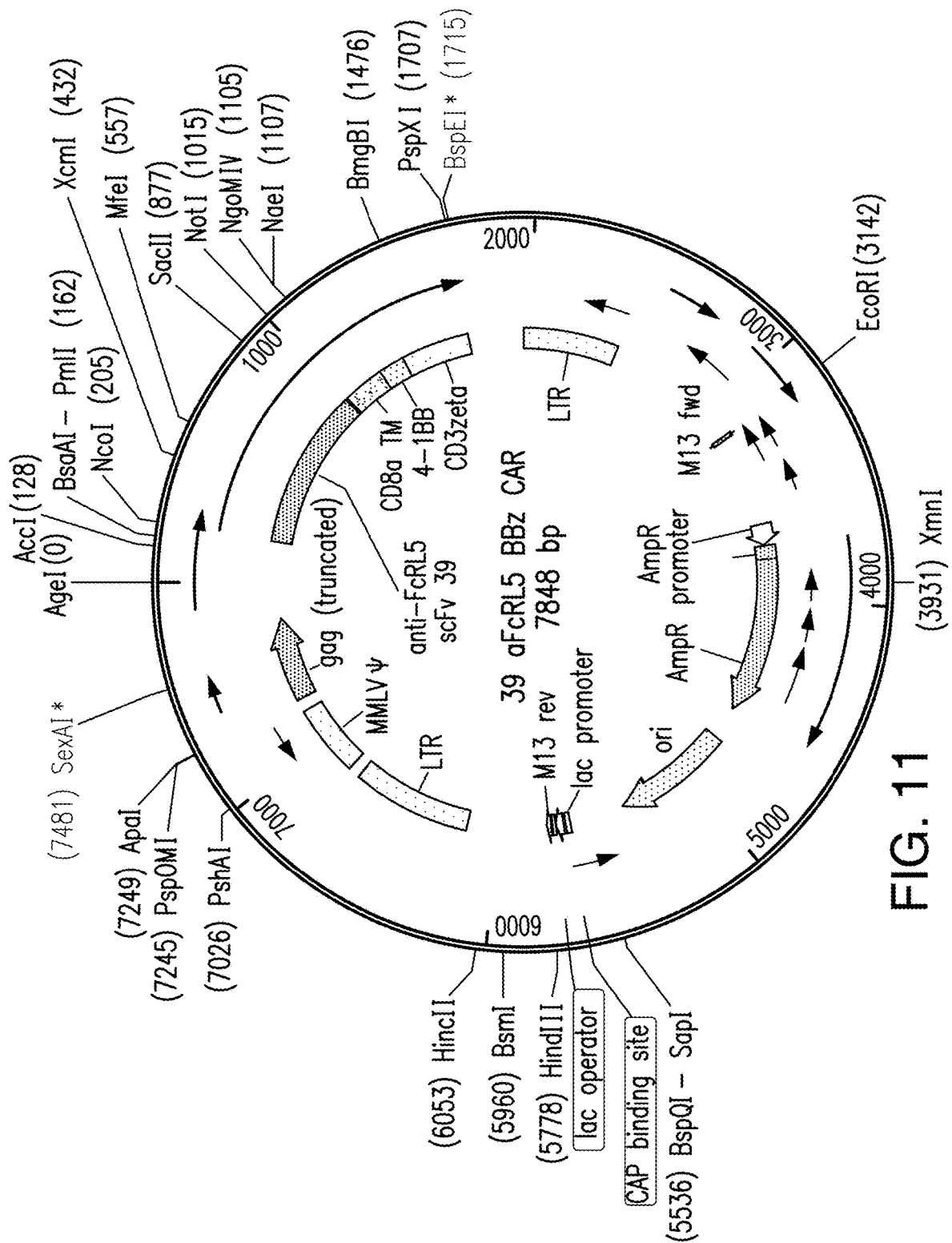
FIG. 11 depicts the vector map of a chimeric antigen receptor targeting FcRL5 using scFV ET200-39 in accordance with one non-limiting embodiment of the presently disclosed subject matter.
Figure 12:
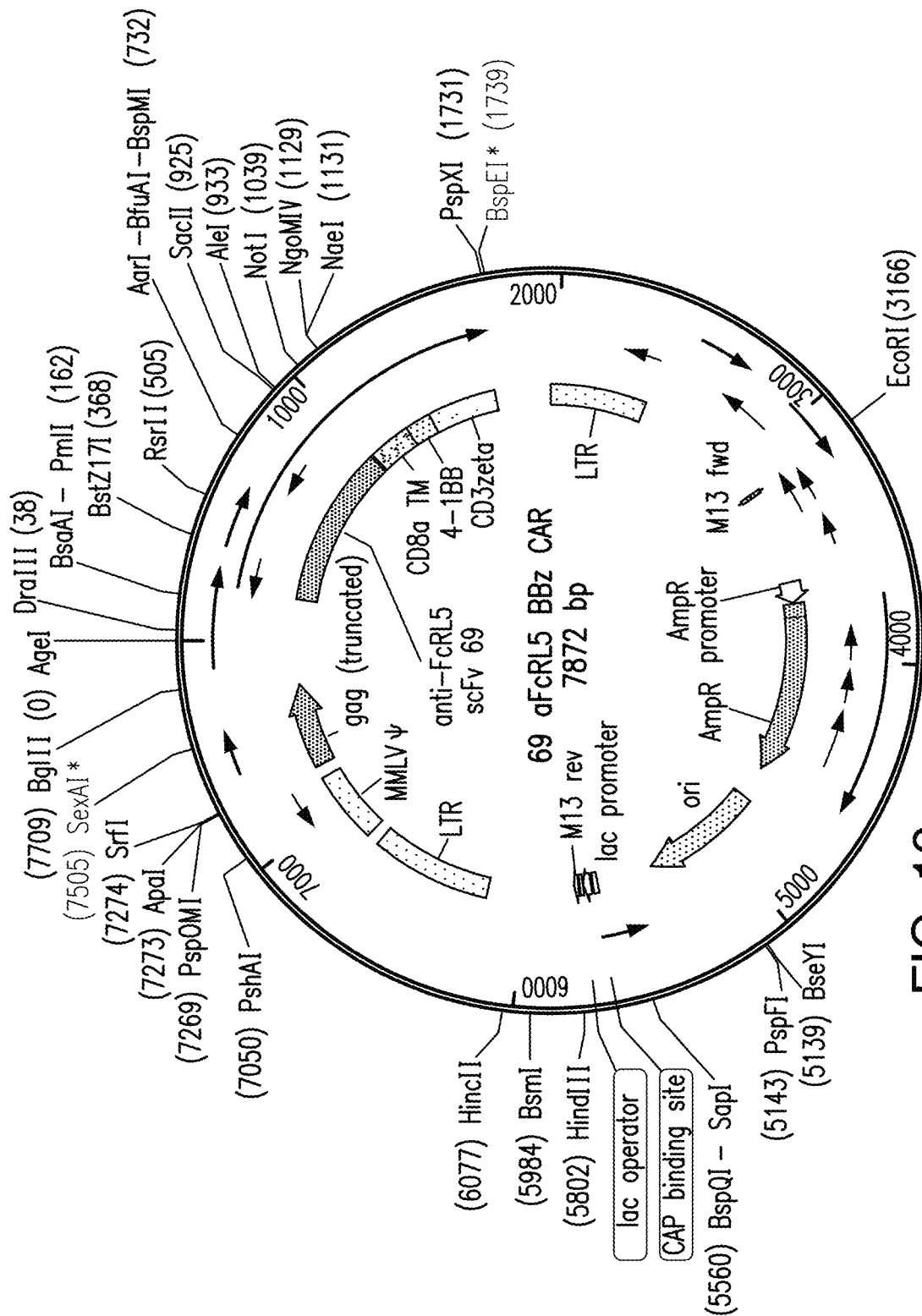
FIG. 12 depicts the vector map of a chimeric antigen receptor targeting FcRL5 using scFV ET200-69 in accordance with one non-limiting embodiment of the presently disclosed subject matter.
Figure 13:
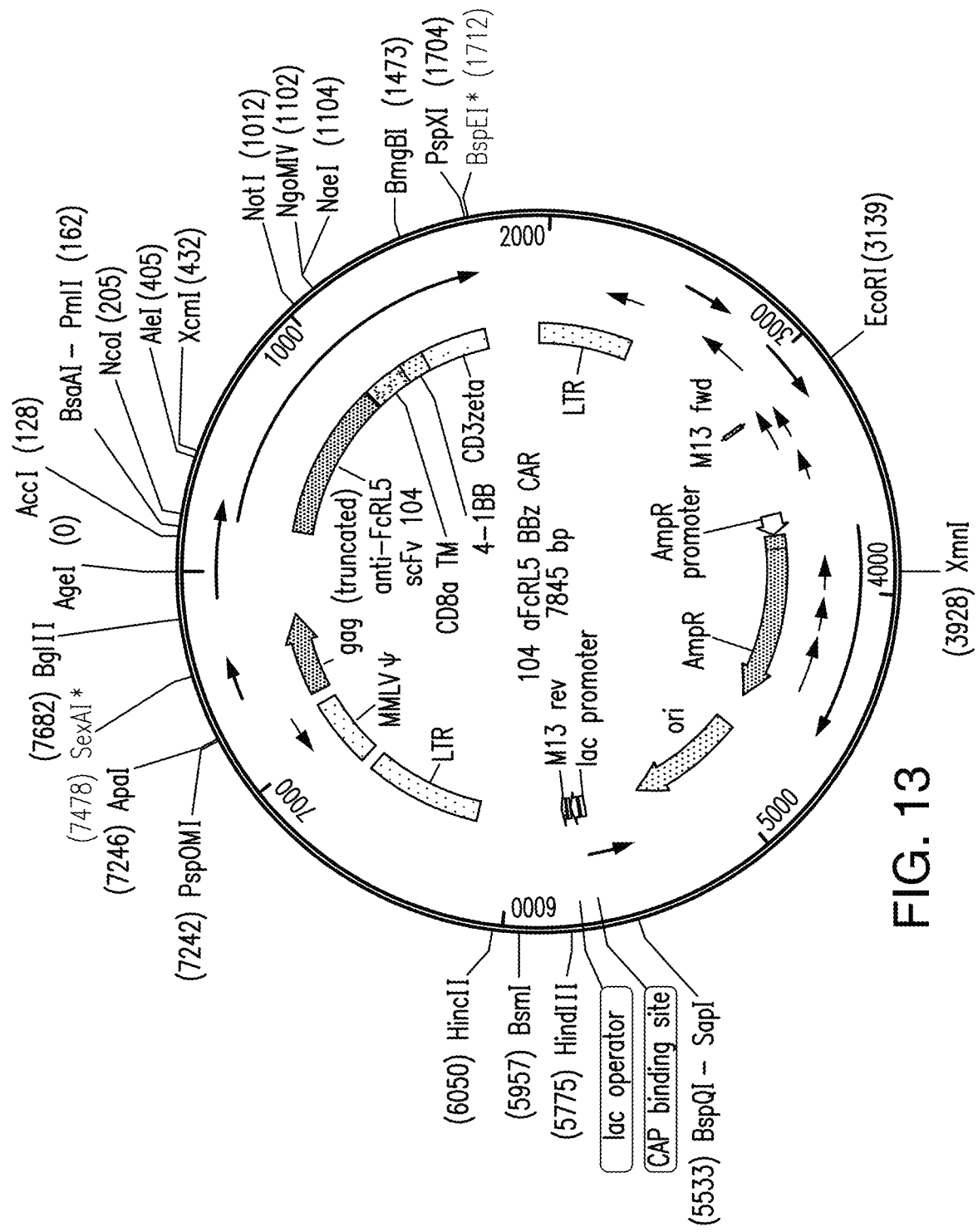
FIG. 13 depicts the vector map of a chimeric antigen receptor targeting FcRL5 using scFV ET200-104 in accordance with one non-limiting embodiment of the presently disclosed subject matter.
Figure 14:
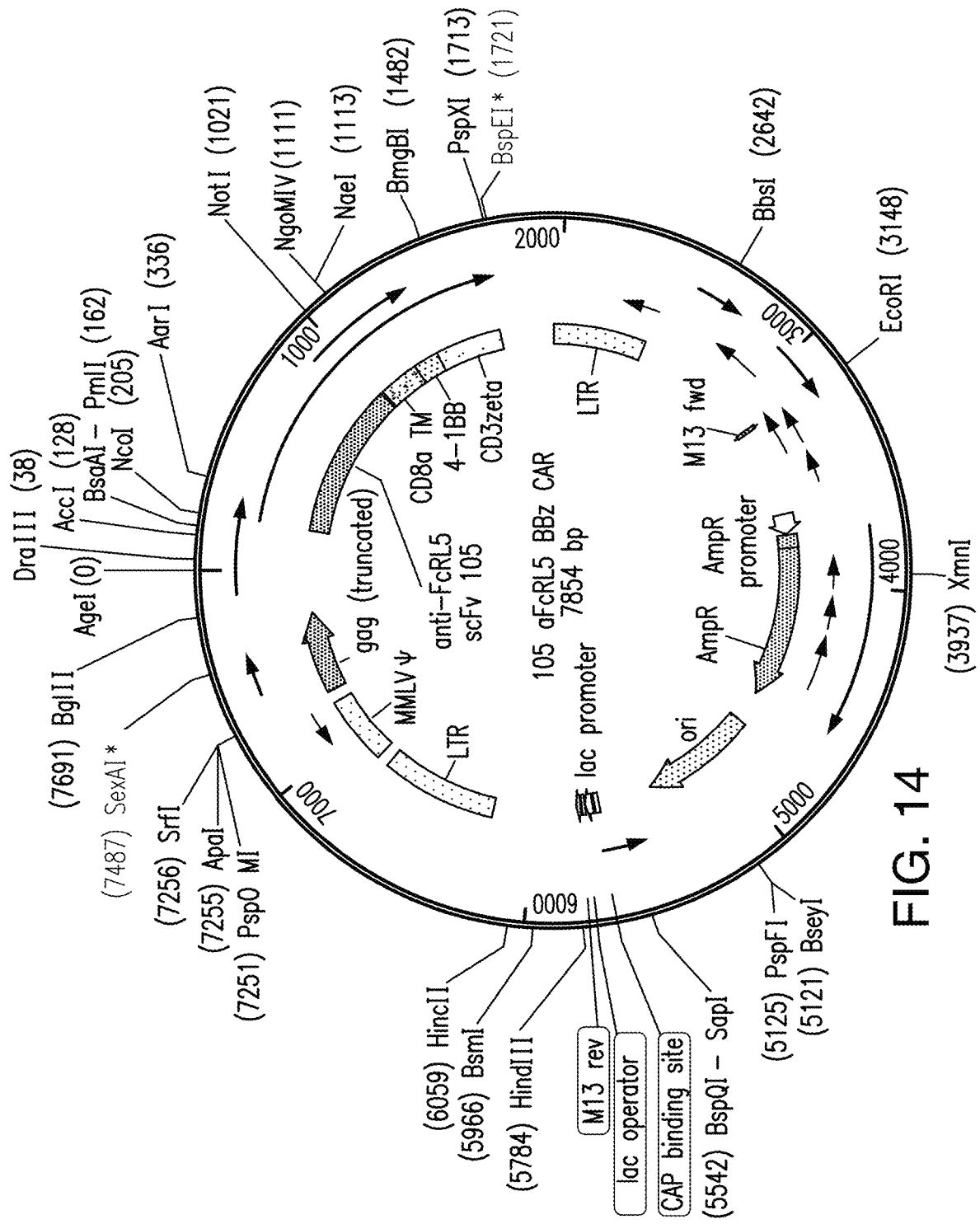
FIG. 14 depicts the vector map of a chimeric antigen receptor targeting FcRL5 using scFV ET200-105 in accordance with one non-limiting embodiment of the presently disclosed subject matter.
Figure 15:
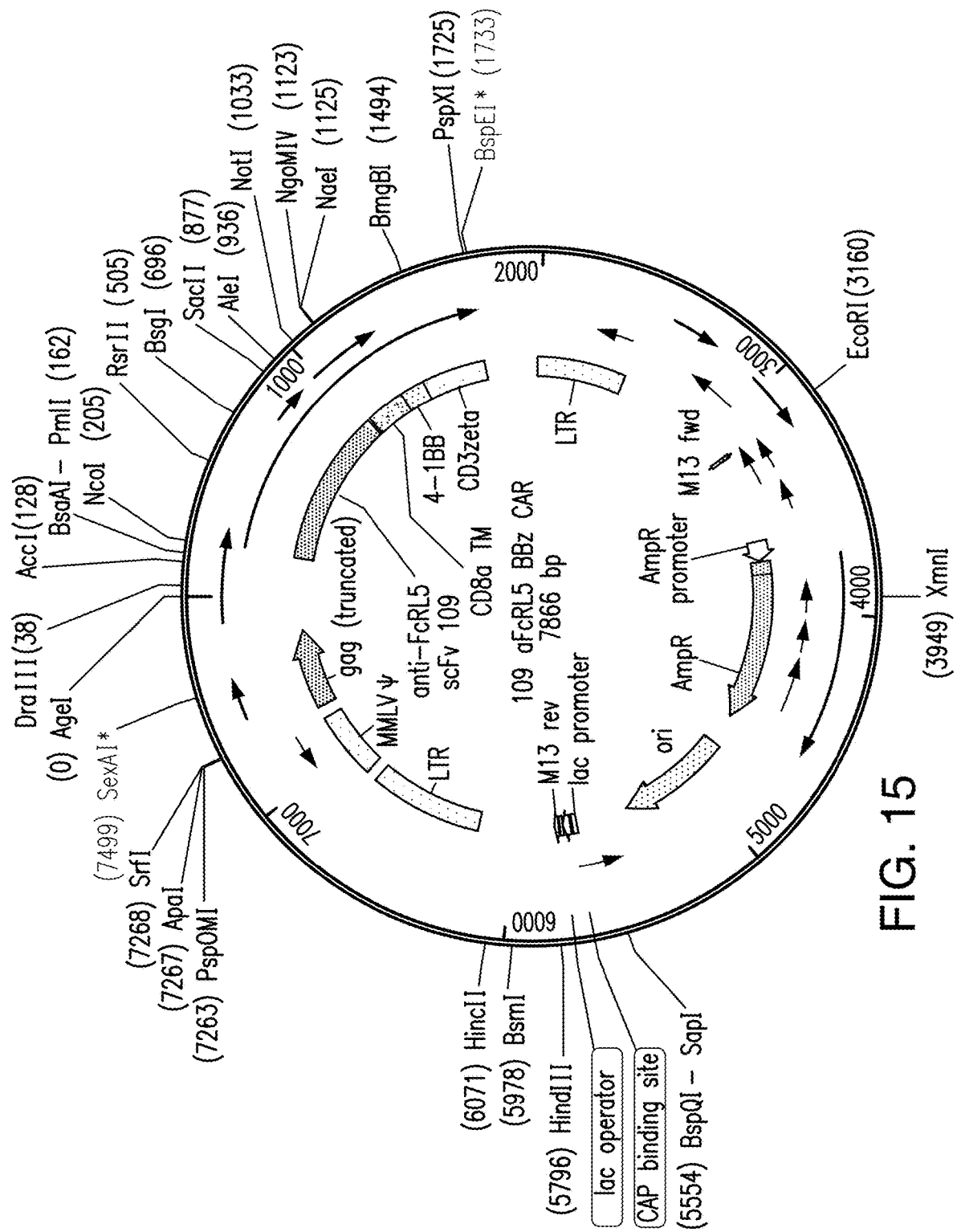
FIG. 15 depicts the vector map of a chimeric antigen receptor targeting FcRL5 using scFV ET200-109 in accordance with one non-limiting embodiment of the presently disclosed subject matter.
Figure 16:
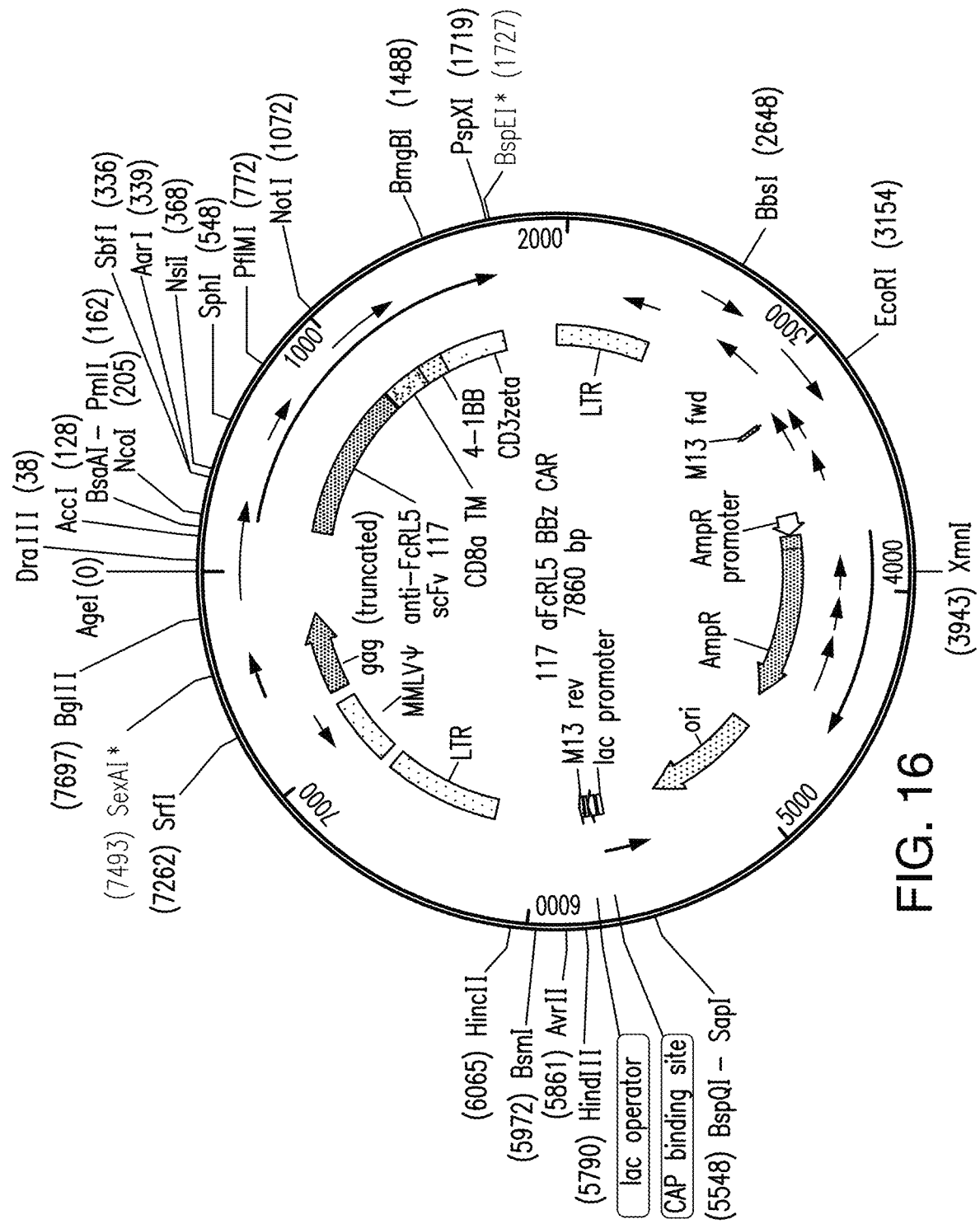
FIG. 16 depicts the vector map of a chimeric antigen receptor targeting FcRL5 using scFV ET200-117 in accordance with one non-limiting embodiment of the presently disclosed subject matter.

To test if the scFvs were specific to domain 9 of FcRL5, the 76 clones were further screened on 3T3 cells overexpressing an vector encoding FcRL5 with a domain 9 deletion (FcRL5Δdom9) and further screened on Raji cells overexpressing full-length FcRL5 (FIG. 4B-D). Some clones showed either reduced or diminished binding towards FcRL5-domain 9 deletion-overexpressing 3T3 cells compared to binding towards FcRL5-overexpressing 3T3 cells. FIGS. 4, 5, 6, 7 and 8 shows the specificity of ET200-39, ET200-104, ET200-105, ET200-109 and ET200-117 for domain 9 of FcRL5, respectively.

Example 4—Construct of Murine FcRL5-Specific CARs

For generation of a scFv targeting human FcRL5, two commercially available mouse hybridomas binding different extracellular epitopes on human FcRL5 (Franco (2013); Ise et al. (2005); Ise et al. (2006)) were obtained. From these hybridomas, two scFvs targeting human FcRL5 were obtained. One scFv was generated by synthesizing the heavy and light chain variable region of murine anti-human FcRL5 antibody F56 as described in Ise et al. (2005) with a G4S linker having the amino acid sequence of SEQ ID NO:897. A second scFv was generated by synthesizing the heavy and light chain variable region of murine anti-human FcRL5 antibody F119 as described in Ise et al. (2005) with a G4S linker having the amino acid sequence of SEQ ID NO:897.

Two FcRL5 CARs were generated: F56 FcRL5-28z CAR and F119 FcRL5-28z CAR. F56 FcRL5-28z CAR and F119 FcRL5-28z CAR have similar structure, e.g., each has a transmembrance domain comprising a CD28 polypeptide, and an intracellular domain comprising a CD3ζ polypeptide and a co-stimulatory signaling region that comprises a CD28 polypeptide, as shown in FIG. 9A. F56 FcRL5-28z CAR comprises an scFv derived from antibody F56, and F119 FcRL5-28z CAR comprises an scFv derived from antibody F119. Each of F56 FcRL5-28z CAR and F119 FcRL5-28z CAR were cloned into a retroviral vector 293galv9. Human T cells (unselected (CD4 and CD8) human T cells from a healthy donor) were transduced with each of F56 FcRL5-28z CAR and F119 FcRL5-28z CAR such that the T cells expressed F56 FcRL5-28z CAR or F119 FcRL5-28z CAR.

Example 5—Construct of Human FcRL5-Specific CARs

This Example discloses the generation of CARs targeting human FcRL5 using the fully human scFvs described herein. ET200-31 scFv, ET200-39 scFv, ET200-69 scFv, ET200-104 scFv, ET200-105 scFv, ET200-109 scFv and ET200-117 scFvs were used to generate second generation FcRL5-targeted CARs designated as 31 FcRL5 BBz CAR, 39 FcRL5 BBz CAR, 69 FcRL5 BBz CAR, 104 FcRL5 BBz CAR, 105 FcRL5 BBz CAR, 109 FcRL5 BBz CAR and 117 FcRL5 BBz CAR with either a 4-1BB co-stimulatory domain and a CD3ζ polypeptide (see FIGS. 9B-16). The FcRL5-targeted 4-1BB containing CARs have a similar structure, e.g., each has a CD8a polypeptide transmembrane domain, and an intracellular domain comprising co-stimulatory signaling region consisting of a CD3ζ polypeptide and a 4-1BB polypeptide, as shown in FIG. 9B. Each of these FcRL5-targeted CARs were cloned into an SFG retroviral vector, as an example the 4-1BB containing CAR vectors are shown in FIGS. 10-16. These viral vectors are then transduced into HEK 293galv9 viral packaging cells in order to generate a stable packaging line for generation of CAR+ T cells.

Example 6—Expression of Human FcRL5-Specific CARs in T Cells

Figure 17:
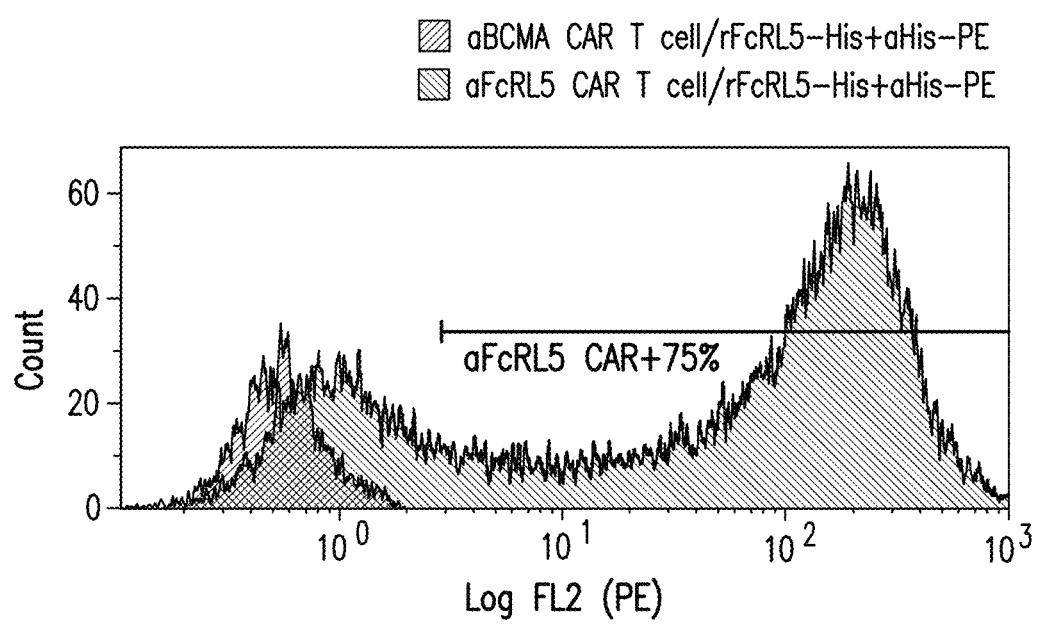
FIG. 17 depicts the expression of FcRL5-targeted chimeric antigen receptors on the surface of transduced T cells.

Human primary T cells were transduced using supernatant from retroviral galv9 HEK 293 packaging cells to express a FcRL5-targeted 4-1BBz CAR (generated using the anti-FcRL5 ET200-104 scFv). The cell surface expression of the FcRL5-targeted CAR was determined by binding to recombinant human FcRL5 which was modified to contain a His tag followed by the binding of a PE conjugated anti-HIS tag secondary antibody, as shown in FIG. 17. Cell surface detection was validated by flow cytometry. As shown in FIG. 17, the FcRL5-targeted CAR was expressed on the transduced T cells.

Example 7—Cytotoxicity of Human FcRL5-Specific CARs

Figure 18:
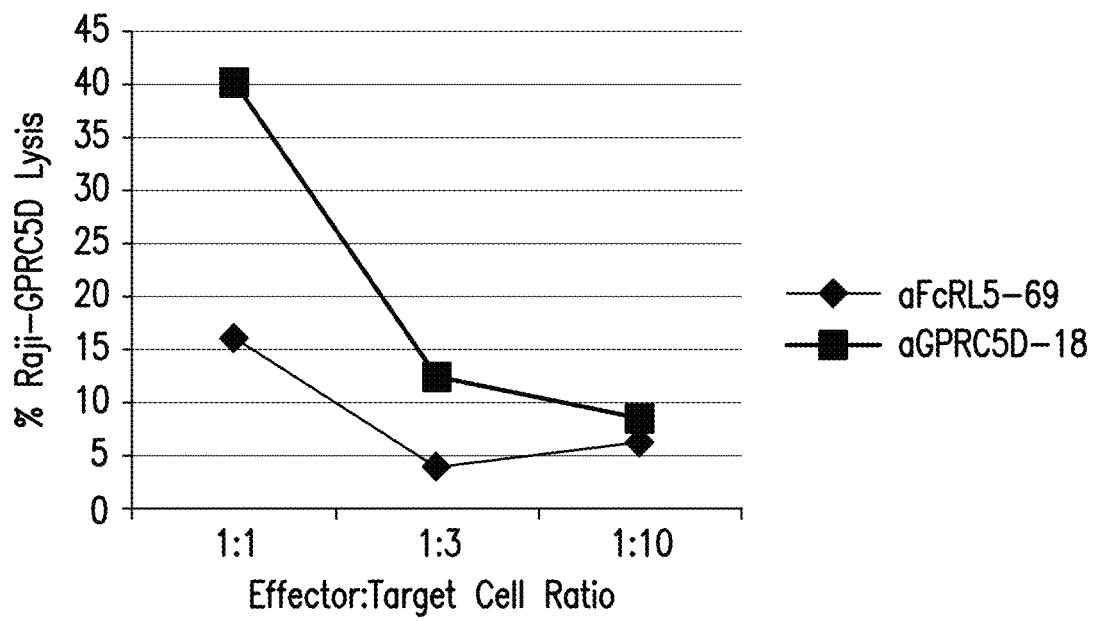
FIG. 18 depicts the cytotoxicity of FcRL5-targeted chimeric antigen receptor T cells for FcRL5-expressing cells.
Figure 18:
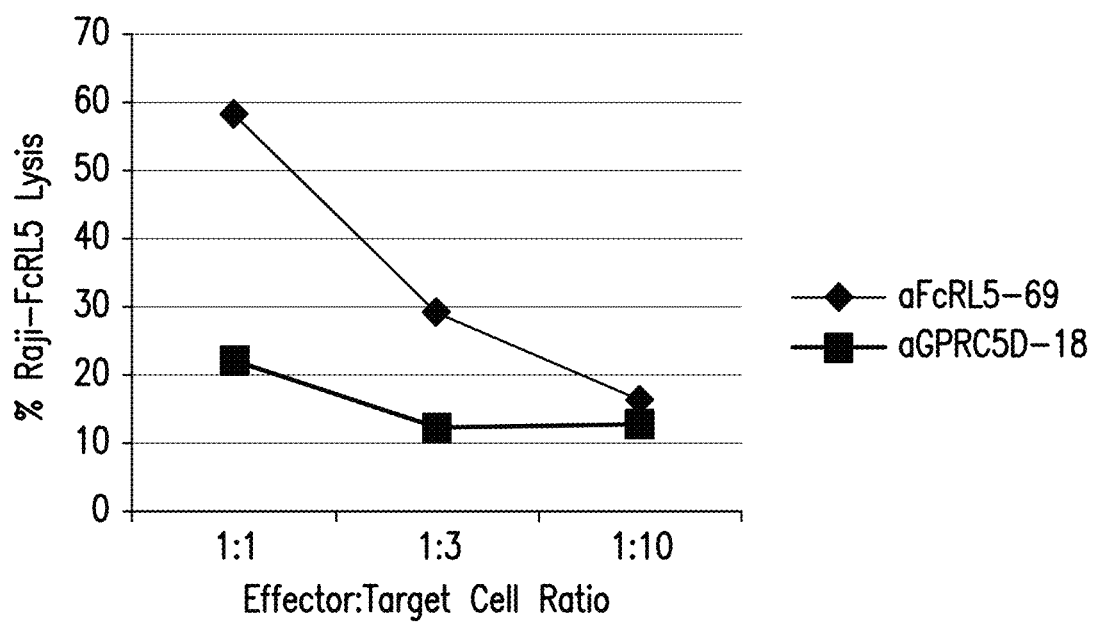

The cytotoxic effects of the FcRL5-targeted 4-1BB CAR T cells were analyzed using Raji (a Burkett's lymphoma cell line) cells transduced to express luciferase and FcRL5 antigen or the control GPRCSD (an irrelevant antigen). T cells expressing the 4-1BB CAR generated using the anti-FcRL5 ET200-69 scFv were used in these experiments (referred to herein as "αFcRL5-69 BBz"). The number of live cells is determined after 36 h co-culture by bioluminescent imaging (BLI). As shown in FIG. 18, FcRL5-targeted CAR T cells specifically lysed Raji cells transduced to express luciferase and FcRL5 antigen (FIG. 18A) but not control GPRCSD expressing Raji cells which are lysed by GPRCSD-targeted CAR T cells (FIG. 18B).

Example 8—Cytokine Secretion of Human FcRL5-Specific CARs

Figure 19:
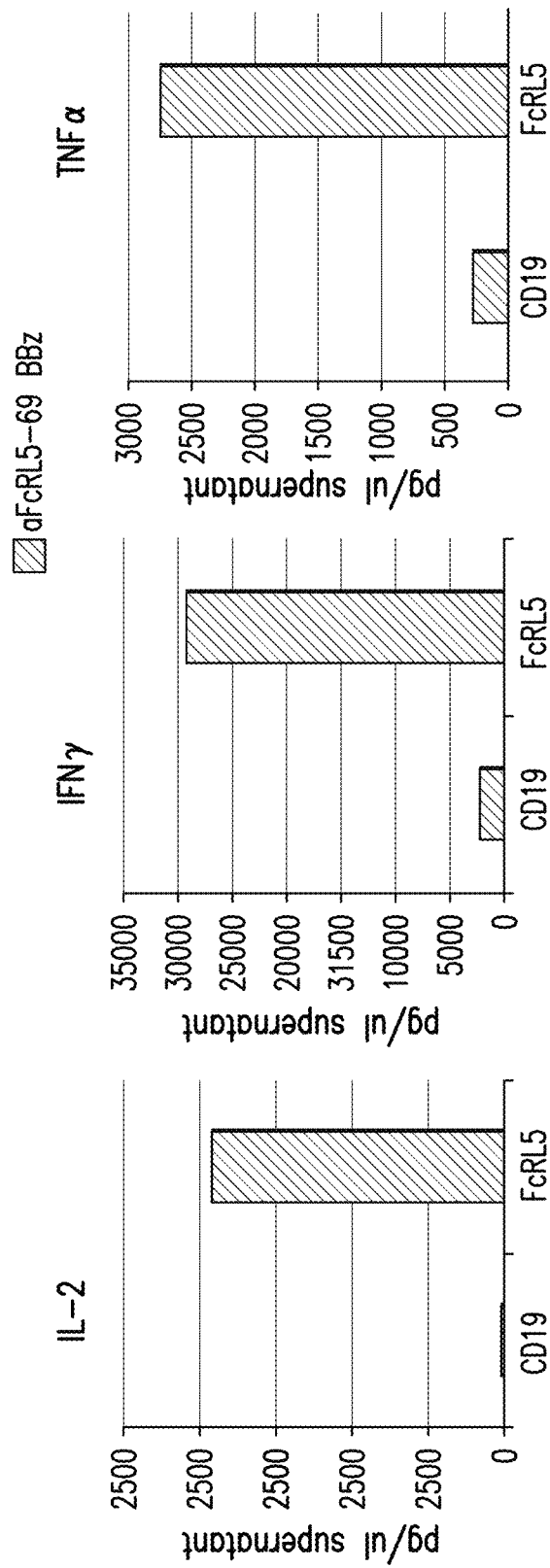
FIG. 19 depicts the induction of cytokine secretion of FcRL5-targeted chimeric antigen receptor T cells.

This Example describes the cytokine secretion of FcRL5-targeted CAR T cells. T cells expressing the 4-1BB CAR generated using the anti-FcRL5 ET200-69 scFv were used in these experiments. IL-2, INFγ, and TNFα secretion after 24 h co-culture of FcRL5 targeted CAR T cells on a monolayer of 3T3 cells transduced with either FcRL5 or CD19 was assessed by Luminex multiplex analysis. As shown in FIG. 19, signaling through the CAR of FcRL5-targeted CAR T cells induced cytokine secretion consistent with T cell activation.

Example 9—Proliferation of Human FcRL5-Specific CARs

Figure 20:
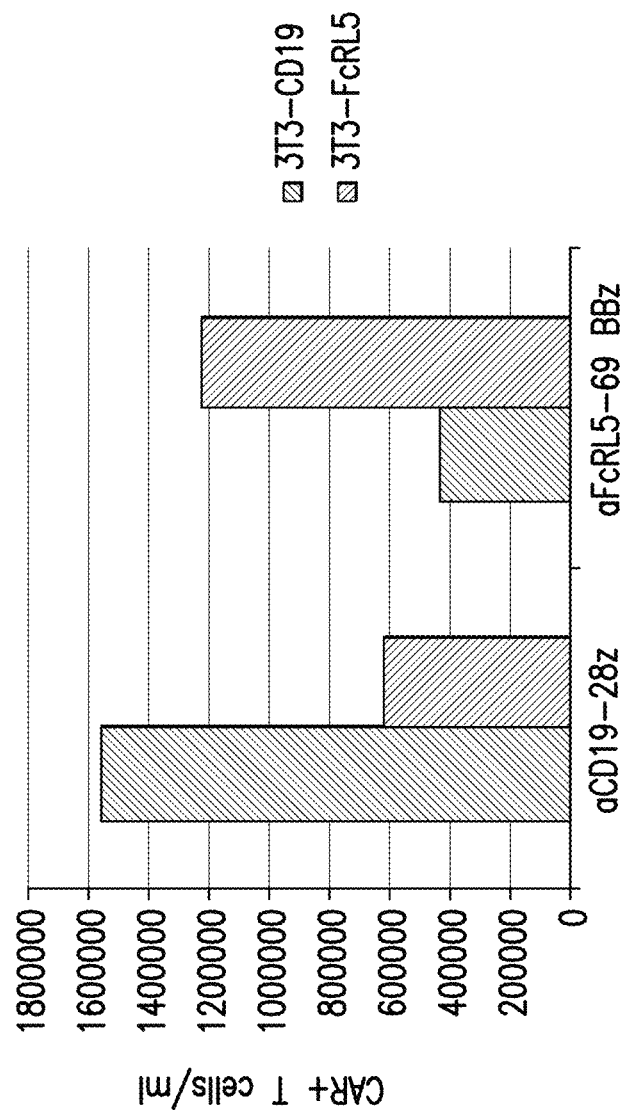
FIG. 20 depicts the proliferation of FcRL5-targeted chimeric antigen receptor T cells upon antigen stimulation.

This Example describes the proliferation of FcRL5-targeted CAR T cells upon antigen stimulation. T cells expressing the 4-1BB CAR generated using the anti-FcRL5 ET200-69 scFv was used in these experiments. 500,000 FcRL5- or CD19-targeted CAR+ T cells/ml were placed on a monolayer of 3T3 cells that have been transduced with either FcRL5 or CD19 (3T3-FcRL; 3T3-CD19). After 4 days, CAR+ T cells were stained and counted by flow cytometry with the inclusion of a known concentration of counting microbeads. As shown in FIG. 20, antigen stimulation of FcRL5-targeted CAR T cells induced proliferation. FcRL5-targeted CAR T cells co-cultured with 3T3-FcRL5 cells expanded to be 2.9 times greater then FcRL5-targeted CAR T cells co-cultured with 3T3-CD19 cells, while control CD19 targeted CAR T cells co-cultured with 3T3-CD19 cells similarly expanded to be 2.5 fold greater then CD19 targeted CAR T cells co-cultured with 3T3-FcRL5 cells (FIG. 20).

Example 10—Epitope Mapping of Human Anti-FcRL5 Antibodies

Two anti-FcRL5 bispecific antibodies, ET200-104 and ET200-117, were analyzed by Pepscan to determine epitope specificity. See Table 239. The target protein is human FcRL5 comprising amino acids 1-851 of SEQ ID NO: 899.

TABLE 239

| Name | Origin | Concentration | Location |
|---|---|---|---|
| ET200-104 bispecific scFV | human | 2.0 mg/ml | +4° C./22 |
| ET200-117 bispecific scFV | human | 1.6 mg/ml | +4° C./22 |

Methods

Figure 21:
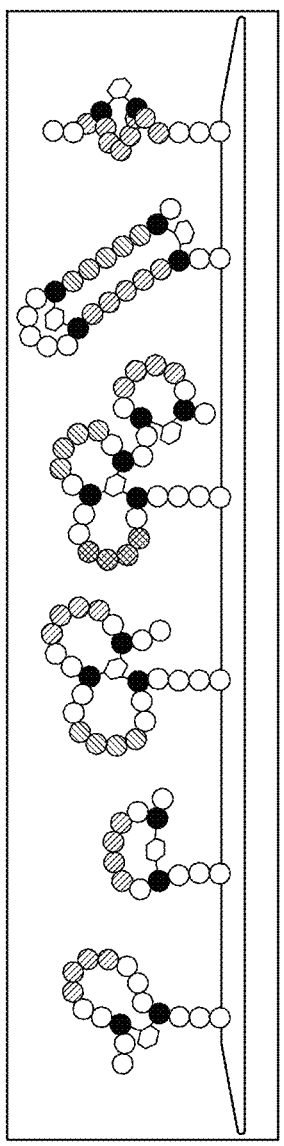
FIG. 21 illustrates the CLIPS technology. The CLIPS reaction takes place between bromo groups of the CLIPS scaffold and thiol sidechains of cysteines. The reaction is fast and specific under mild conditions. Using this elegant chemistry, native protein sequences are transformed into CLIPS constructs with a range of structures. From left to right: two different single T2 loops, T3 double loop, conjugated T2+T3 loops, stabilized beta sheet, and stabilized alpha helix (Timmerman et al., J. Mol. Recognit. 2007; 20: 283-29).
Figure 21:
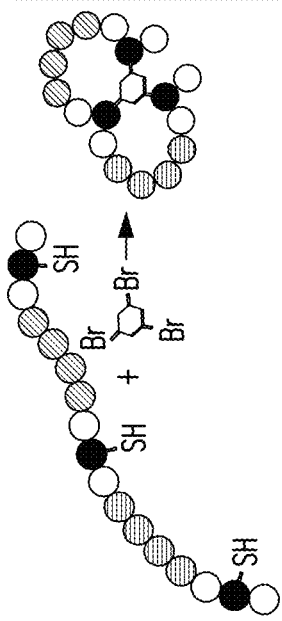

The principles of clips technology. CLIPS technology structurally fixes peptides into defined three-dimensional structures. This results in functional mimics of even the most complex binding sites. CLIPS technology is now routinely used to shape peptide libraries into single, double or triple looped structures as well as sheet- and helix-like folds (FIG. 21).

Figure 22:
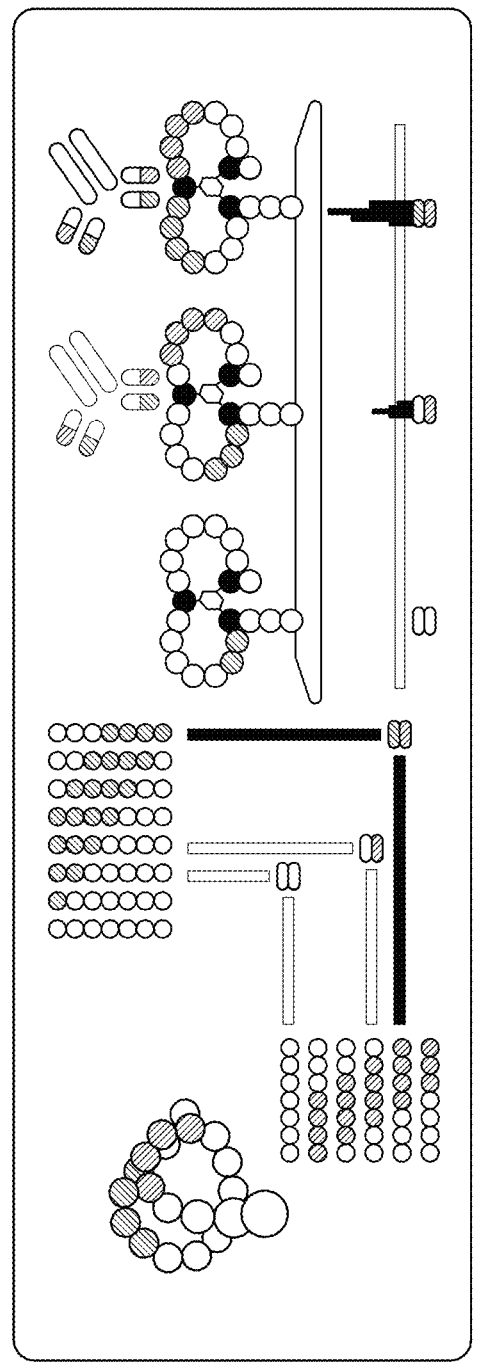
FIG. 22 illustrates combinatorial clips library screening. The target protein (left) containing a discontinuous conformational epitope is converted into a matrix library (middle). Combinatorial peptides are synthesized on a proprietary minicard and chemically converted into spatially defined CLIPS constructs (right).
Figure 22:

Combinatorial clips library screening in detail. CLIPS library screening starts with the conversion of the target protein into a library of up to 10,000 overlapping peptide constructs, using a combinatorial matrix design. On a solid carrier, a matrix of linear peptides is synthesized, which are subsequently shaped into spatially defined CLIPS constructs (FIG. 22). Constructs representing both parts of the discontinuous epitope in the correct conformation bind the antibody with high affinity, which is detected and quantified. Constructs presenting the incomplete epitope bind the antibody with lower affinity, whereas constructs not containing the epitope do not bind at all. Affinity information is used in iterative screens to define the sequence and conformation of epitopes in detail.

Figure 23:
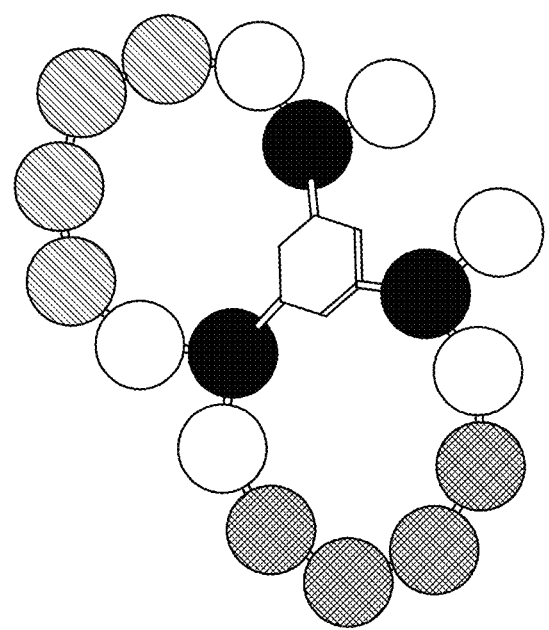
FIG. 23 depicts T3 looped CLIPSTM construct.
Figures 24A, 24B, 24C, 24D:
FIG. 24A-D illustrates heat map technology. (A) Table of combined peptides, with two sub-sequences indicated as "Loop 1" and "Loop 2." (B) Data from A displayed as a matrix. (C) Color bar indication of the heat map representation. (D) Heat map visualization of data from A.

Heat map analysis. A heat map is a graphical representation of data where the values taken by a variable in a two-dimensional map are represented as colors. For double-looped CLIPS peptides, such a two-dimensional map can be derived from the independent sequences of the first and second loops. For example, the sequences of the 16 CLIPS peptides depicted in FIG. 24 are effectively permutations of 4 unique sub-sequences in loop 1 (colored in blue in FIG. 23) and 4 unique sub-sequences in loop 2 (colored in green in FIG. 23). Thus, the observed ELISA data (colored in red in FIG. 24A) can be plotted in a 4×4 matrix, where each X coordinate corresponds to the sequence of the first loop, and each Y coordinate corresponds to the sequence of the second loop. For instance, the ELISA value observed for CLIPS peptide CLSSERERVEDLFEYECELLTSEPIFHCRQEDC (indicated with an arrow in FIG. 23A) can be found at the third row, third column of FIG. 24B (indicated with an arrow and a red square). To further facilitate the visualization, ELISA values can be replaced with colors from a continuous gradient. In this case, extremely low values are colored in green, extremely high values are colored in red, and average values are colored in black (see FIG. 24C). For the aforementioned example, the average value is 0.71. When this color map is applied to the data matrix depicted in FIG. 24B, a color heat map is obtained (see FIG. 24D, the original data is still indicated for extra clarity).

Synthesis of peptides. To reconstruct epitopes of the target molecule a library of peptides was synthesized. An amino functionalized polypropylene support was obtained by grafting with a proprietary hydrophilic polymer formulation, followed by reaction with t-butyloxycarbonyl-hexamethyl-enediamine (BocHMDA) using dicyclohexylcarbodiimide (DCC) with Nhydroxybenzotriazole (HOBt) and subsequent cleavage of the Boc-groups using trifluoroacetic acid (TFA). Standard Fmoc-peptide synthesis was used to synthesize peptides on the amino-functionalized solid support by custom modified JANUS liquid handling stations (Perkin Elmer). Synthesis of structural mimics was done using Pepscan's proprietary Chemically Linked Peptides on Scaffolds (CLIPS) technology. CLIPS technology allows to structure peptides into single loops, doubleloops, triple loops, sheet-like folds, helix-like folds and combinations thereof. CLIPS templates are coupled to cysteine residues. The side-chains of multiple cysteines in the peptides were coupled to one or two CLIPS templates. For example, a 0.5 mM solution of the P2 CLIPS (2,6-bis(bromomethyl)pyridine) was dissolved in ammonium bicarbonate (20 mM, pH 7.8)/acetonitrile (1:3 (v/v)). This solution was added onto the peptide arrays. The CLIPS template bound to side-chains of two cysteines as present in the solid-phase bound peptides of the peptide-arrays (455 wells plate with 3 µl wells). The peptide arrays were gently shaken in the solution for 30 to 60 minutes while completely covered in solution. Finally, the peptide arrays were washed extensively with excess of $H_2O$ and sonicated in disrupt-buffer containing 1% SDS/ 0.1% beta-mercaptoethanol in PBS (pH 7.2) at 70° C. for 30 minutes, followed by sonication in $H_2O$ for another 45 minutes. The T3 CLIPS carrying peptides were made in a similar way but now with three cysteines.

ELISA Screening. The binding of antibody to each of the synthesized peptides was tested in a PEPSCAN-based ELISA. The peptide arrays were incubated with primary antibody solution (overnight at 4° C.). After washing, the peptide arrays were incubated with a 1/1000 dilution of an appropriate antibody peroxidase conjugate (SBA) for one hour at 25° C. After washing, the peroxidase substrate 2,2'-azino-di-3-ethylbenzthiazoline sulfonate (ABTS) and 2 µl/ml of 3 percent $H_2O_2$ were added. After one hour, the color development was measured. The color development was quantified with a charge coupled device (CCD)—camera and an image processing system.

Data processing. The values obtained from the CCD camera ranged from 0 to 3000 mAU, similar to a standard 96-well plate ELISA-reader. The results were quantified and stored into the Peplab database. Occasionally a well contained an air-bubble resulting in a false-positive value, the cards were manually inspected and any values caused by an air-bubble were scored as 0.

Synthesis quality control. To verify the quality of the synthesized peptides, a separate set of positive and negative control peptides was synthesized in parallel. These were screened with antibody 57.9 (ref. Posthumus et al., J. Virology, 1990, 64:3304-3309).

Results

Screening. Antibody binding depends on a combination of factors, including concentration of the antibody and the amounts and nature of competing proteins in the ELISA buffer. Also, the pre-coat conditions (the specific treatment of the peptide arrays prior to incubation with the experimental sample) affected binding. These details are summed up in Table 240. For the Pepscan Buffer and Preconditioning (SQ), the numbers indicate the relative amount of competing protein (a combination of horse serum and ovalbumin).

TABLE 240

| Screening conditions | | | |
|---|---|---|---|
| Label | Dilution | Sample Buffer | Pre-conditioning |
| ET200-104 | 8 µg/ml | PBS-Tween | PBS-Tween |
| ET200-117 | 3 µg/ml | PBS-Tween | 0.1% SQ |

Antibodies ET200-104 and ET200-117 were coated at 1 µg/ml on a Nunc Maxisorp plate for ELISA and detected with Goat Anti-Human Ig-HRP (Southern Biotech; #2010/05), the same conjugate that is used in minicard screenings. For ET200-104 and ET200-117 signal >1 OD was obtained for some dilutions of the secondary Ab, indicating that the secondary antibody is well suited for detection of these mAbs.

Figures 1, 25:
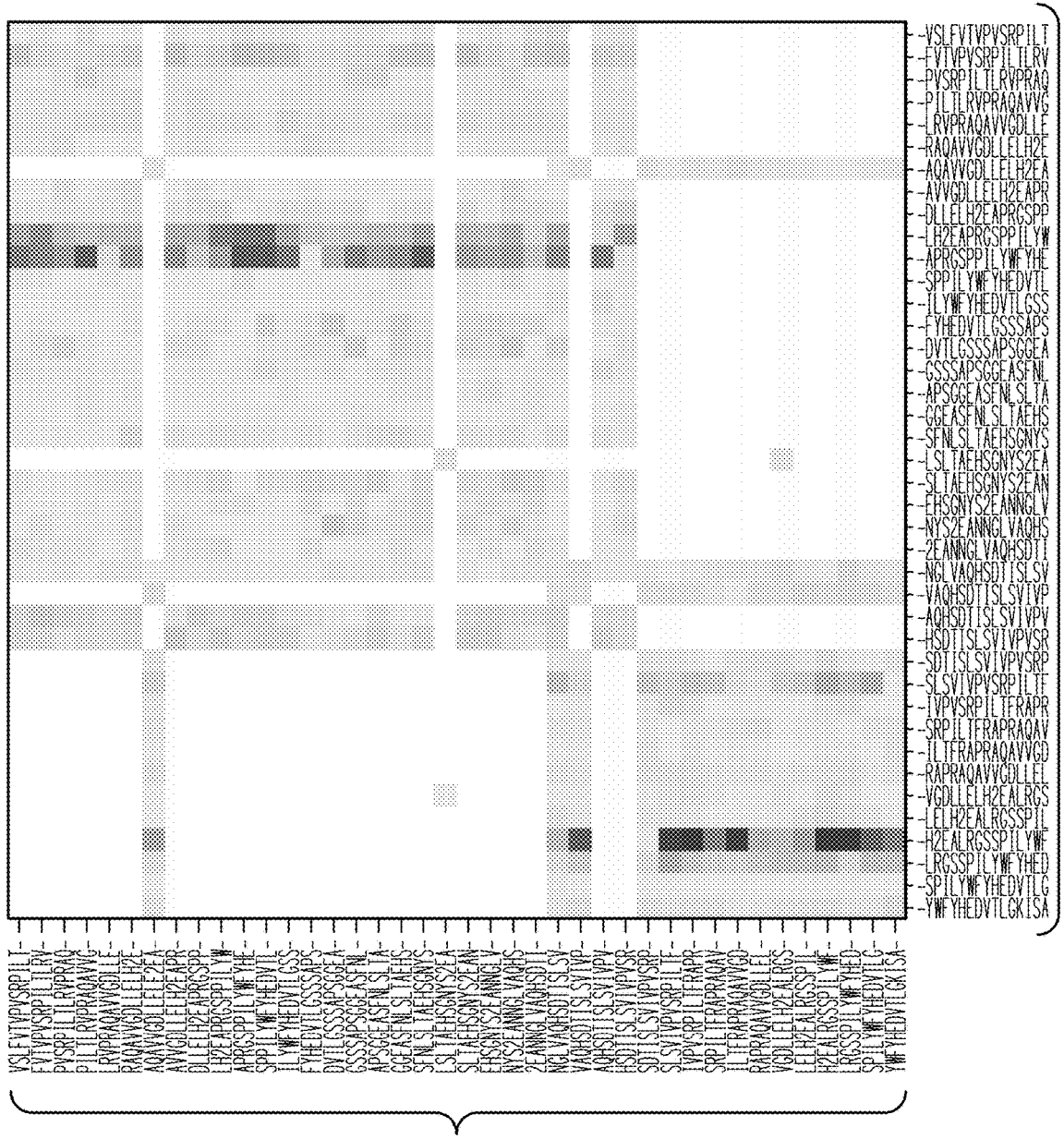
FIG. 25 shows heatmap analysis of data recorded for Herceptin.
Figures 4, 25:
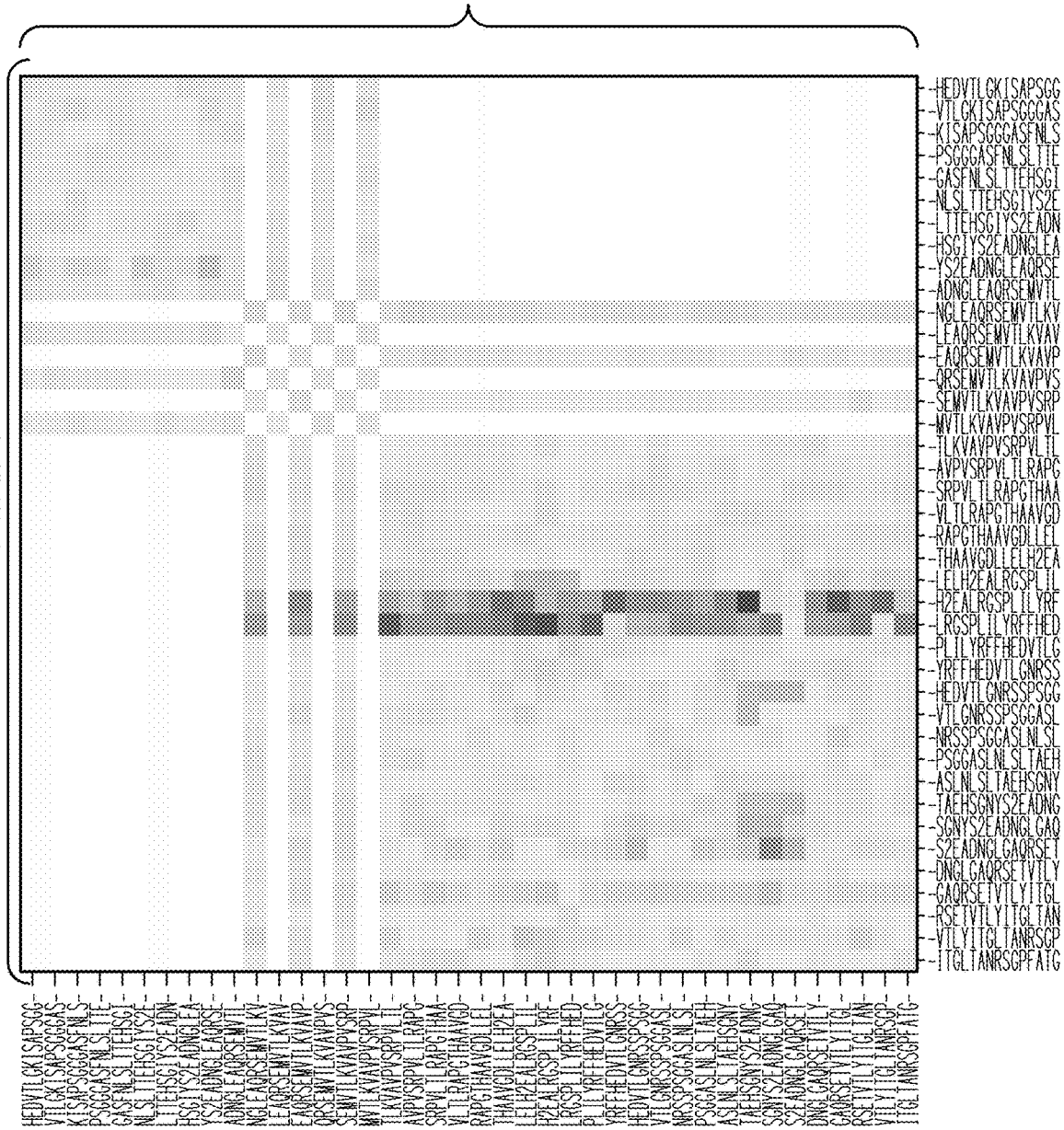

Herceptin was used as an internal negative control at high concentration in the absence of blocking buffer. Herceptin bound peptides with common sequences LRGSPLILYRF, LRGSSPILYWF and APRGSPPILYW (FIG. 25). Peptides containing aforementioned sequences were excluded from epitope candidates for test samples.

Figures 1, 26:
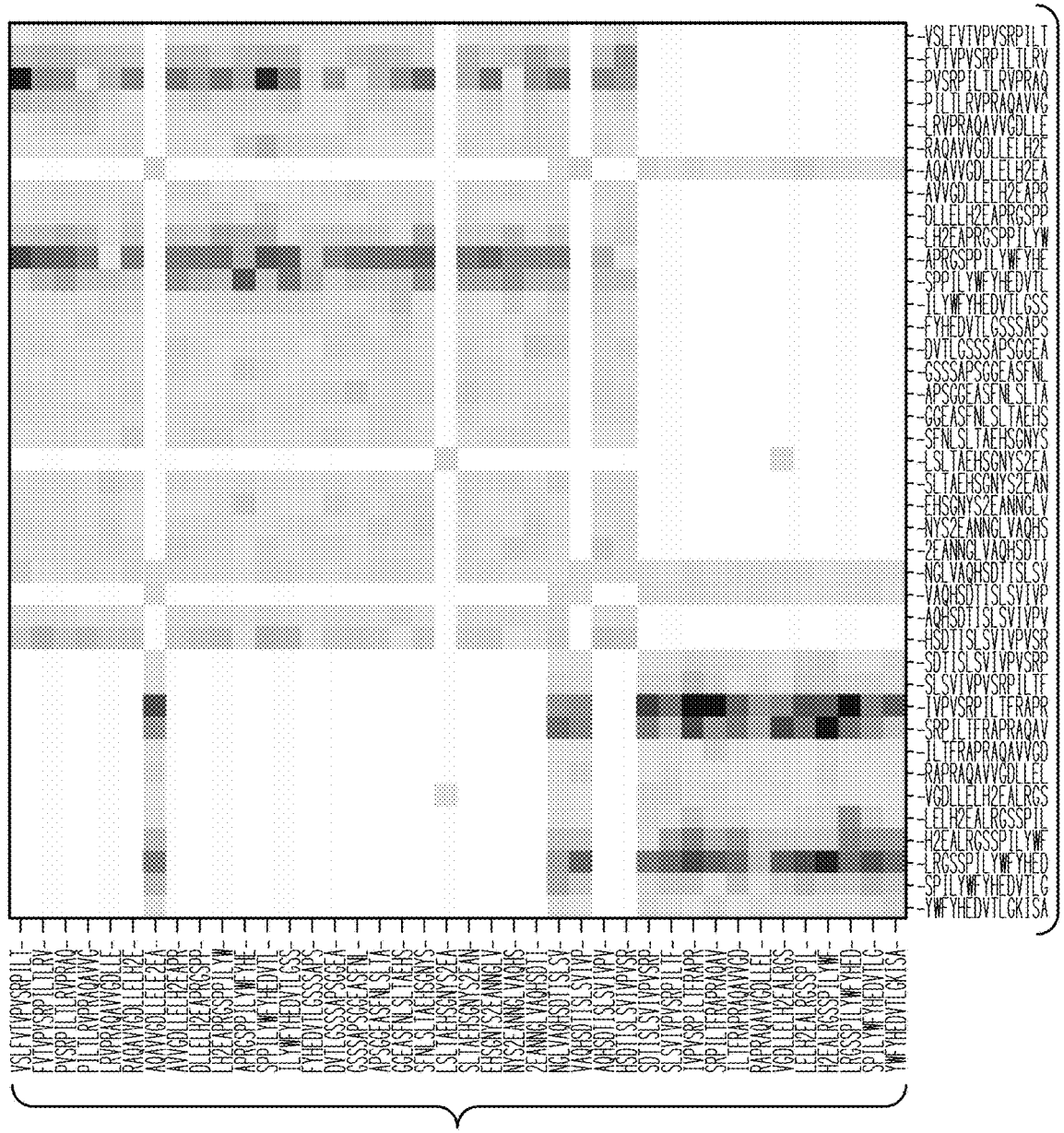
FIG. 26 shows heatmap analysis of data recorded for ET200-104.
Figures 2, 26:
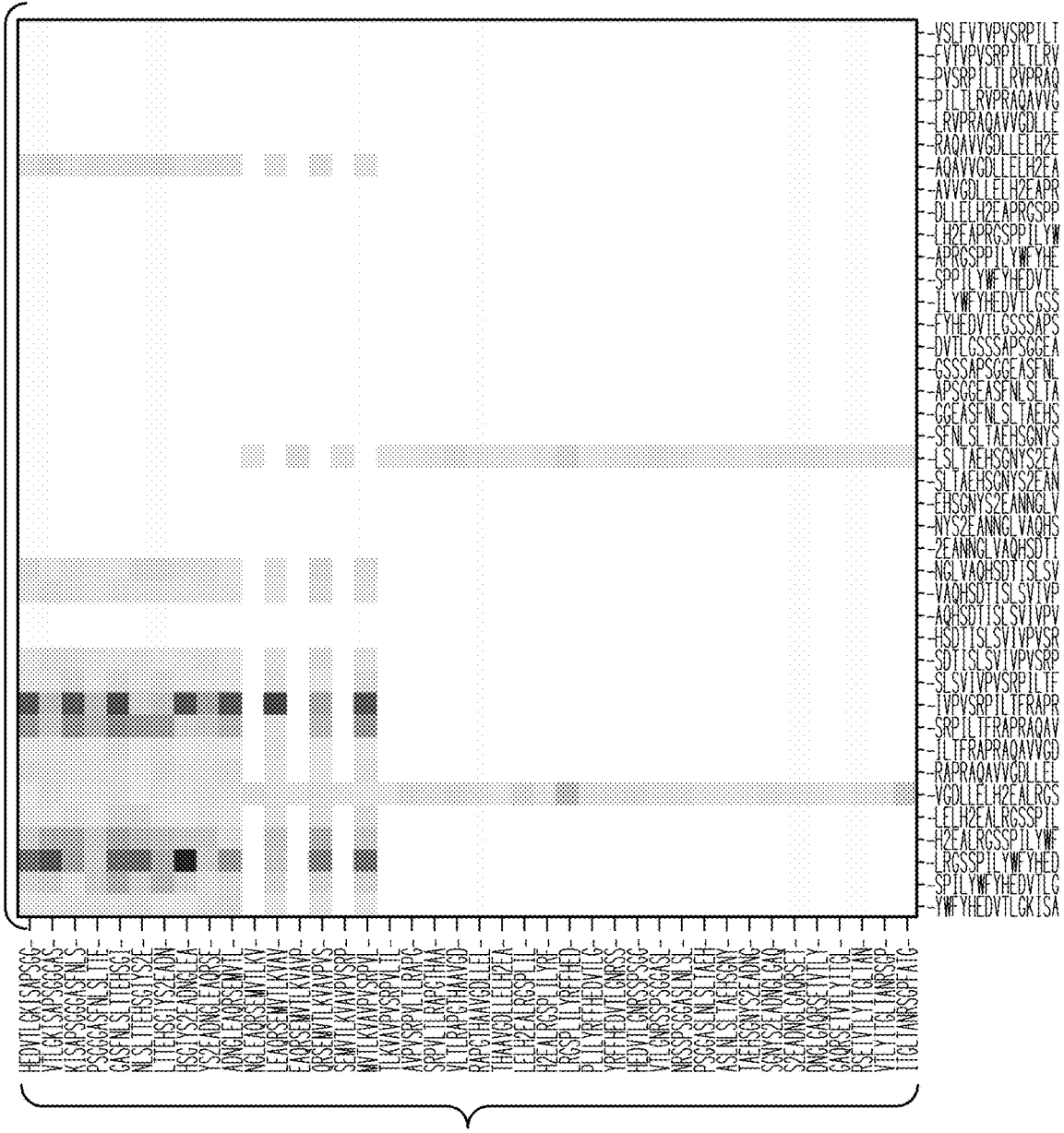
Figures 3, 26:
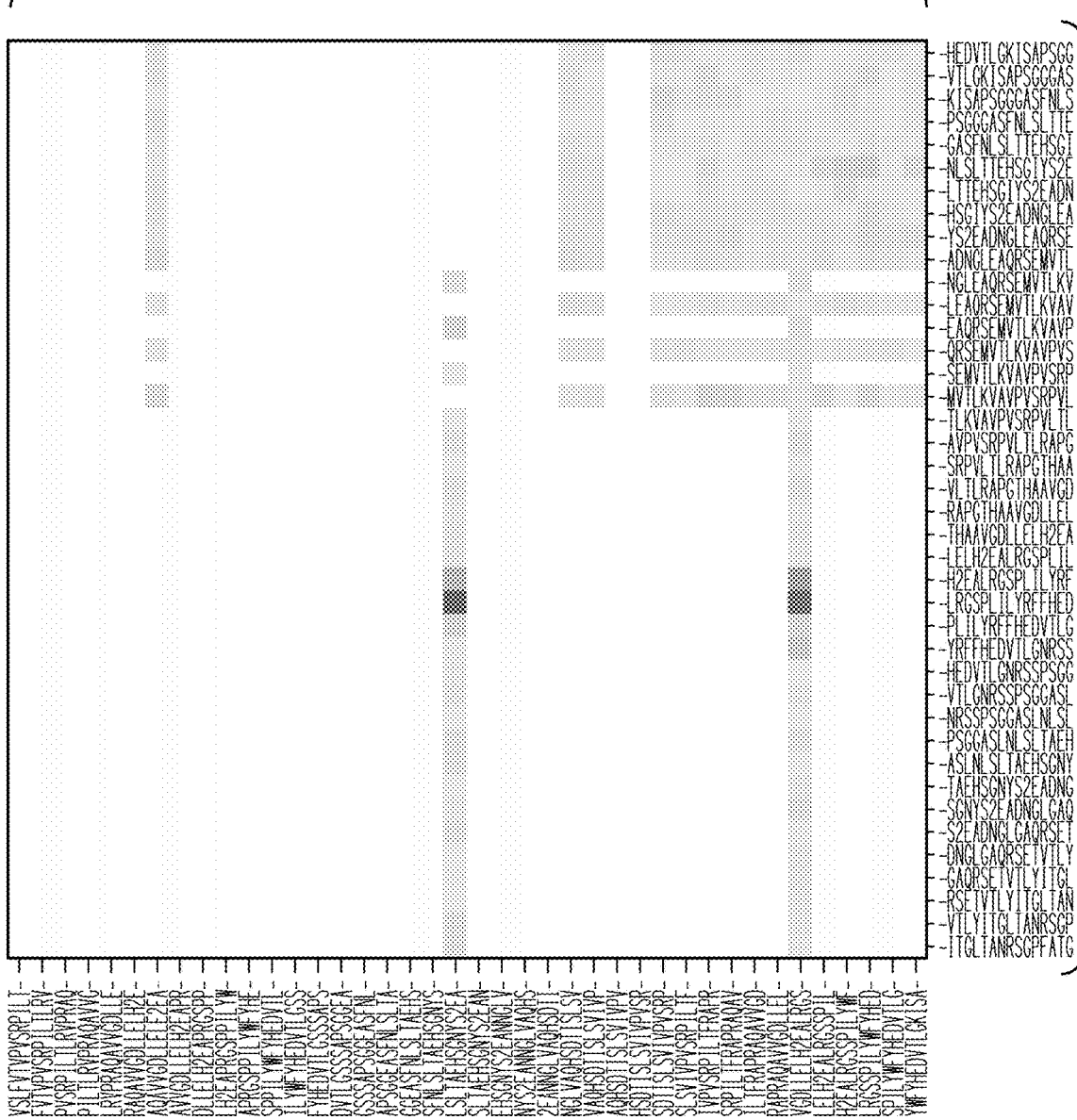
Figures 4, 26:
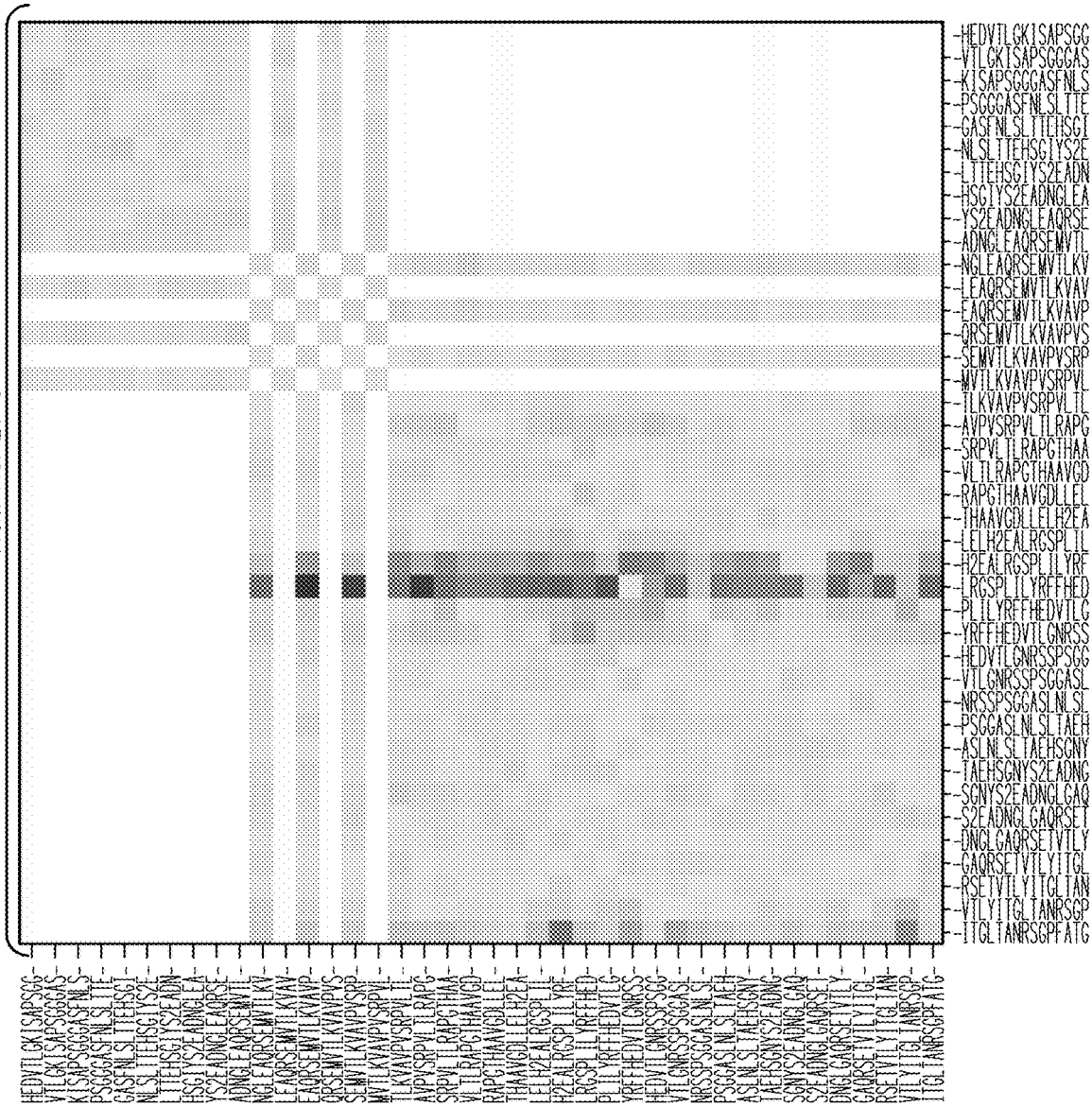

When tested under low stringency conditions and at a high concentration antibody ET200-104 binds multiple peptide motifs in all sets (FIG. 26). The majority of peptides bound were suspected to be the result of non-specific hydrophic interactions based on the results obtained for Herceptin (internal negative control). However, binding of peptides containing motif $_{657}$SRPILTFRAPR$_{667}$ was proposed to be specific, and was uniquely attributed to sample ET200-104.

When tested under low stringency conditions antibody ET200-117 resulted in weak binding of multiple peptide motifs on all sets. Cumulative data analysis of data obtained for all sets suggests that the antibody uniquely recognizes a region containing peptide stretch $_{829}$RSETVTLYITGL$_{840}$ in domain 9 of Fc receptor-like protein 5 distinct from the Herceptin internal negative control and ET200-104. Again the majority of other peptides bound were suspected to be the result of unspecific hydrophic interactions that shared as the same binding pattern was recorded under low stringency conditions for antibody ET200-104.

CONCLUSIONS

Figure 27:
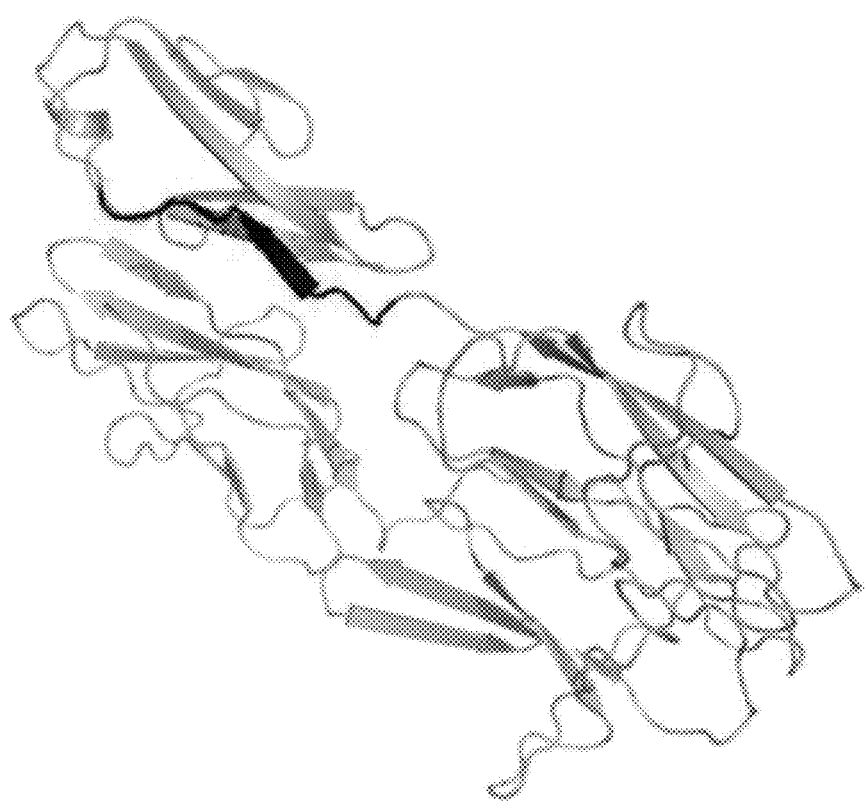
FIG. 27 illustrates a 3D model of amino acid residues 380-731 of FcRL55 with peptide stretch $_{657}$SRPILTFRAPR$_{667}$ highlighted.

Cumulative data analysis of results collected for ET200-104, and ET200-117 vs. Herceptin suggest that antibody ET200-104 targets residues $_{657}$SRPILTFRAPR$_{667}$ within domain 8 of Fc receptor-like protein 5 and antibody ET200-117 targets residues $_{829}$RSETVTLYITGL$_{840}$ within domain 9. Additionally, for both samples multiple signals were recorded with peptides non-specifically bound by Herceptin. The epitope candidate identified for ET200-104 was visualized using a publically available 3D model of Fc receptor-like protein 5 (FIG. 27). The epitope candidate for ET200-117 lies within the non-modeled part of the target and therefore cannot be visualized.

REFERENCES

1. Franco, A., et al. Human Fc receptor-like 5 binds intact IgG via mechanisms distinct from those of Fc receptors. *Journal of immunology* 190, 5739-5746 (2013).
2. Dement-Brown, J., et al. Fc receptor-like 5 promotes B cell proliferation and drives the development of cells displaying switched isotypes. *Journal of leukocyte biology* 91, 59-67 (2012).
3. Ise, T., et al. Elevation of soluble CD307 (IRTA2/FcRH5) protein in the blood and expression on malignant cells of patients with multiple myeloma, chronic lymphocytic leukemia, and mantle cell lymphoma. *Leukemia* 21, 169-174 (2007).
4. Elkins, K., et al. FcRL5 as a target of antibody-drug conjugates for the treatment of multiple myeloma. *Molecular cancer therapeutics* 11, 2222-2232 (2012).
5. Hatzivassiliou, G., et al. IRTA1 and IRTA2, novel immunoglobulin superfamily receptors expressed in B cells and involved in chromosome 1q21 abnormalities in B cell malignancy. *Immunity* 14, 277-289 (2001).
6. An, G., et al. Chromosome 1q21 gains confer inferior outcomes in multiple myeloma treated with bortezomib but copy number variation and percentage of plasma cells involved have no additional prognostic value. *Haematologica* 99, 353-359 (2014).
7. Ise, T., et al. Immunoglobulin superfamily receptor translocation associated 2 protein on lymphoma cell lines and hairy cell leukemia cells detected by novel monoclonal antibodies. *Clinical cancer research: an official journal of the American Association for Cancer Research* 11, 87-96 (2005).
8. Ise, T., Kreitman, R. J., Pastan, I. & Nagata, S. Sandwich ELISAs for soluble immunoglobulin superfamily receptor translocation-associated 2 (IRTA2)/FcRH5 (CD307) proteins in human sera. *Clinical chemistry and laboratory medicine: CCLM/FESCC* 44, 594-602 (2006).
9. Brentjens, R. J., et al. Safety and persistence of adoptively transferred autologous CD19-targeted T cells in patients with relapsed or chemotherapy refractory B-cell leukemias. *Blood* 118, 4817-4828 (2011).
10. Brentjens, R. J., et al. Eradication of systemic B-cell tumors by genetically targeted human T lymphocytes co-stimulated by CD80 and interleukin-15. *Nature medicine* 9, 279-286 (2003).
11. Brentjens, R. J., et al. CD19-Targeted T Cells Rapidly Induce Molecular Remissions in Adults with Chemotherapy-Refractory Acute Lymphoblastic Leukemia. *Science translational medicine* 5, 177ra138 (2013).
12. Davila, M. L., et al. Efficacy and Toxicity Management of 19-28z CAR T Cell Therapy in B Cell Acute Lymphoblastic Leukemia. *Science translational medicine* 6, 224ra225 (2014).
13. Siegel, R., Naishadham, D. & Jemal, A. Cancer statistics, 2013. *CA: a cancer journal for clinicians* 63, 11-30 (2013).
14. Boyd, K. D., et al. The clinical impact and molecular biology of del (17p) in multiple myeloma treated with conventional or thalidomide-based therapy. *Genes, chromosomes & cancer* 50, 765-774 (2011).
15. Shaughnessy, J. D., Jr., et al. A validated gene expression model of high-risk multiple myeloma is defined by deregulated expression of genes mapping to chromosome 1. *Blood* 109, 2276-2284 (2007).
16. Gahrton, G., et al. Allogeneic bone marrow transplantation in multiple myeloma. European Group for Bone Marrow Transplantation. *The New England journal of medicine* 325, 1267-1273 (1991).
17. Pegram, H. J., et al. Tumor-targeted T cells modified to secrete IL-12 eradicate systemic tumors without need for prior conditioning. *Blood* 119, 4133-4141 (2012).
18. Sabrina Bertilaccio, M. T., et al. Low-Dose Lenalidomide Improves CAR-Based Immunotherapy In CLL By Reverting T-Cell Defects In Vivo. *Blood* 122, 4171 (2013).
19. Bataille, R., et al. The phenotype of normal, reactive and malignant plasma cells. Identification of "many and multiple myelomas" and of new targets for myeloma therapy. *Haematologica* 91, 1234-1240 (2006).
20. Morgan, R. A., et al. Case report of a serious adverse event following the administration of T cells transduced with a chimeric antigen receptor recognizing ERBB2. *Molecular therapy: the journal of the American Society of Gene Therapy* 18, 843-851 (2010).
21. Brentjens, R. J., et al. Safety and persistence of adoptively transferred autologous CD19-targeted T cells in patients with relapsed or chemotherapy refractory B-cell leukemias. *Blood* 118, 4817-4828 (2011).
22. Brentjens, R. J., et al. CD19-targeted T cells rapidly induce molecular remissions in adults with chemotherapy-refractory acute lymphoblastic leukemia. *Science translational medicine* 5, 177ra138 (2013).
23. Hunder, N. N., et al. Treatment of metastatic melanoma with autologous CD4+ T cells against NY-ESO-1. *N. Engl. J. Med.* 358, 2698-2703 (2008).
24. Rosenberg, S. A., Restifo, N. P., Yang, J. C., Morgan, R. A. & Dudley, M. E. Adoptive cell transfer: a clinical path to effective cancer immunotherapy. *Nat. Rev. Cancer* 8, 299-308 (2008).
25. Dudley, M. E., et al. Adoptive cell therapy for patients with metastatic melanoma: evaluation of intensive myeloablative chemoradiation preparative regimens. *J Clin Oncol* 26, 5233-5239 (2008).

26. Brentjens, R. J., et al. Genetically targeted T cells eradicate systemic acute lymphoblastic leukemia xenografts. *Clin. Cancer Res.* 13, 5426-5435 (2007).
27. Gade, T. P., et al. Targeted elimination of prostate cancer by genetically directed human T lymphocytes. *Cancer Res.* 65, 9080-9088 (2005).
28. Maher, J., Brentjens, R. J., Gunset, G., Riviere, I. & Sadelain, M. Human T-lymphocyte cytotoxicity and proliferation directed by a single chimeric TCRzeta/CD28 receptor. *Nat. Biotechnol.* 20, 70-75 (2002).
29. Kershaw, M. H., et al. Gene-engineered T cells as a superior adjuvant therapy for metastatic cancer. *J Immunol* 173, 2143-2150 (2004).
30. Sadelain, M., Brentjens, R. & Riviere, I. The promise and potential pitfalls of chimeric antigen receptors. *Curr Opin Immunol* (2009).
31. Hollyman, D., et al. Manufacturing validation of biologically functional T cells targeted to CD19 antigen for autologous adoptive cell therapy. *J Immunother* 32, 169-180 (2009).
32. Sadelain, M., Brentjens, R. & Riviere, I. The basic principles of chimeric antigen receptor design. *Cancer discovery* 3, 388-398 (2013).
33. Riviere, I., Sadelain, M. & Brentjens, R. J. Novel strategies for cancer therapy: the potential of genetically modified T lymphocytes. *Curr Hematol Rep* 3, 290-297 (2004).
34. Stephan, M. T., et al. T cell-encoded CD80 and 4-1BBL induce auto- and transco-stimulation, resulting in potent tumor rejection. *Nat. Med.* 13, 1440-1449 (2007).
35. Krause, A., et al. Antigen-dependent CD28 signaling selectively enhances survival and proliferation in genetically modified activated human primary T lymphocytes. *J Exp Med* 188, 619-626 (1998).
36. Gong, M. C., et al. Cancer patient T cells genetically targeted to prostate-specific membrane antigen specifically lyse prostate cancer cells and release cytokines in response to prostate-specific membrane antigen. *Neoplasia.* 1, 123-127 (1999).
37. Lyddane, C., et al. Cutting Edge: CD28 controls dominant regulatory T cell activity during active immunization. *J. Immunol.* 176, 3306-3310 (2006).

From the foregoing description, it will be apparent that variations and modifications may be made to the invention described herein to adopt it to various usages and conditions. Such embodiments are also within the scope of the following claims.

All patents and publications and sequences referred to by accession or reference number mentioned in this specification are herein incorporated by reference to the same extent as if each independent patent and publication and sequence was specifically and individually indicated to be incorporated by reference.

SEQUENCE LISTING (1149 sequences)

SEQ ID NO: 1 - DNA, 333 bp, Artificial Sequence
  Description of Artificial Sequence: Synthetic polynucleotide
cagtctgtgttgacgcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggt

SEQ ID NO: 2 - DNA, 351 bp, Artificial Sequence
  Description of Artificial Sequence: Synthetic polynucleotide
caggtgcagctacagcagtggggcgcaggactgttgaagccttcggagaccctgtccctcacctgcgctgtgtatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgcgaaggtccgtacgacggtttcgattcttggggtcaaggtactctggtgaccgtctcctca

SEQ ID NO: 3 - protein, 111 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLG

SEQ ID NO: 4 - protein, 117 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGPYDGFDSWGQGTLVTVSS

SEQ ID NO: 5 - DNA, 336 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattctgtggtattcggcggagggaccaagctgaccgtcctaggt

SEQ ID NO: 6 - DNA, 348 bp, Artificial Sequence
  Description of Artificial Sequence: Synthetic polynucleotide
caggtccagctggtacagtctggcactgaggtgaagaagcctggggcctcagtgagggtcgcctgcaaggcttctggttacccctttaacaaatatgacatcaactgggtgcgacaggcccctggacaagggcttgagtggatgggaggcatcatccctatctttcgtacaacaaactacgcacagaagttccagggcagagtcacgattaccgcggacgaatccacgagcacagcctacatggagctgagcagcctgagatctgaggacacggccgtatattactgtgcgcgcgaatggttctactgggatatctggggtcaaggtactctggtgaccgtctcctca

SEQ ID NO: 7 - protein, 112 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSVVFGGGTKLTVLG

SEQ ID NO: 8 - protein, 116 aa, Artificial Sequence
  Description of Artificial Sequence: Synthetic polypeptide
QVQLVQSGTEVKKPGASVRVACKASGYPFNKYDINWVRQAPGQGLEWMGGIIPIFRTTNYAQKFQGRVTITADESTSTAYMELSSLRSEDTAVYYCAREWFYWDIWGQGTLVTVSS

SEQ ID NO: 9 - DNA, 324 bp, Artificial Sequence
  Description of Artificial Sequence: Synthetic polynucleotide
cagtctgtgttgactcagccaccctcagtgtccgtgtccccaggacagacagccagcatctcctgctctggaaataaattggggactaagtatgtttactggtatcagaagaggccaggccagtcccctgtgttggtcatgtatgaagataatcagcggccctcagggatcccggagcggttctctggctccaactctgggaacacagccactctgaccatcagagggacccagactgtggatgaggctgactattactgtcaggcgtgggactccgacactttcgtggtcttcggcggagggaccaaggtcaccgtcctaggt

SEQ ID NO: 10 - DNA, 363 bp, Artificial Sequence
  Description of Artificial Sequence: Synthetic polynucleotide
gaggtgcagctggtggagaccgggggaggcgtggtccagcctgggaggtccctgagactctcctgtgcagcctctggattcaccttcagtagttatggcatgcactgggtccgccaggctccaggcaaggggctggagtgggtggcagttatatcacatgatggaagtaataaatactacgcagactccgtgaagggccgattcaccatctccagagacaattccaaggacacgctgtatctgcaaatgaacagcctgagaggtgaggacacggccgtatattactgtgcgcgctctaaccagtggtctggttacttctctttcgattactggggtcaaggtactctggtgaccgtctcctca

SEQ ID NO: 11 - protein, 108 aa, Artificial Sequence
  Description of Artificial Sequence: Synthetic polypeptide
QSVLTQPPSVSVSPGQTASISCSGNKLGTKYVYWYQKRPGQSPVLVMYEDNQRPSGIPERFSGSNSGNTATLTIRGTQTVDEADYYCQAWDSDTFVVFGGGTKVTVLG

SEQ ID NO: 12 - protein, 121 aa, Artificial Sequence
  Description of Artificial Sequence: Synthetic polypeptide
EVQLVETGGGVVQPGRSLRLSCAASGFTFSSYGMHWVRQAPGKGLEWVAVISHDGSNKYYADSVKGRFTISRDNSKDTLYLQMNSLRGEDTAVYYCARSNQWSGYFSFDYWGQGTLVTVSS

SEQ ID NO: 13 - DNA, 330 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtggtggtcatccattatgatagcgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggt

SEQ ID NO: 14 - DNA, 351 bp, Artificial Sequence
  Description of Artificial Sequence: Synthetic polynucleotide
gaggtgcagctggtgcagtctggagctgaggtgaagaagcctggggcctcagtgaaggtctcctgcaaggcttctggttacacctttaccacctatggtatcagctgggtgcgacaggcccctggacaagggcttgagtggatgggatggatcaacacttacaatggtcacacaaactatgcacagaagctccagggcagagccacaatgaccgcagacacatccacgaacacagcctacatggagctgaggagcctgagatctgacgacactgccgtgtattactgtgcgcgcgttatctacggttctggtgattactggggtcaaggtactctggtgaccgtctcctca

SEQ ID NO: 15 - protein, 110 aa, Artificial Sequence
  Description of Artificial Sequence: Synthetic polypeptide
SYVLTQPPSVSVAPGKTARITCGGNNIGSKSVHWYQQKPGQAPVVVIHYDSDRPSGIPERFSGSNSGNTATLTISRVEAGDEADYYCQVWDSSSDHPYVFGTGTKVTVLG

SEQ ID NO: 16 - protein, 117 aa, Artificial Sequence
  Description of Artificial Sequence: Synthetic polypeptide
EVQLVQSGAEVKKPGASVKVSCKASGYTFTTYGISWVRQAPGQGLEWMGWINTYNGHTNYAQKLQGRATMTADTSTNTAYMELRSLRSDDTAVYYCARVIYGSGDYWGQGTLVTVSS

SEQ ID NO: 17 - DNA, 327 bp, Artificial Sequence
  Description of Artificial Sequence: Synthetic polynucleotide
tcctatgtgctgactcagccactctcagtgtcagtggccccaggaaagacggccaggattacctgtgggggaaacaacattggaagtaaaactgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatcgggtgttcggcggagggaccaagctgaccgtcctaggt

SEQ ID NO: 18 - DNA, 348 bp, Artificial Sequence
  Description of Artificial Sequence: Synthetic polynucleotide
caggtgcagctgcaggagtcgggcccaggactggtgaagccttcggagaccctgtccctcacctgcaatgtctctggttactccatcagcagtggttacttttggggctggatccggcagcccccagggaaggggctggagtggattgggagtatctatcatagtaggagcacctactacaacccgtccctcaagagtcgagtcaccatatcagtagacacgtccaagaaccagttctccctgaagctgaactctgtgaccgccgcagacacggccgtgtattactgtgcgcgcggttacggttacttcgattactggggtcaaggtactctggtgaccgtctcctca

SEQ ID NO: 19 - protein, 109 aa, Artificial Sequence
  Description of Artificial Sequence: Synthetic polypeptide
SYVLTQPLSVSVAPGKTARITCGGNNIGSKTVHWYQQKPGQAPVLVIYYDSDRPSGIPERFSGSNSGNTATLTISRVEAGDEADYYCQVWDSSSDHRVFGGGTKLTVLG

SEQ ID NO: 20 - protein, 116 aa, Artificial Sequence
  Description of Artificial Sequence: Synthetic polypeptide
QVQLQESGPGLVKPSETLSLTCNVSGYSISSGYFWGWIRQPPGKGLEWIGSIYHSRSTYYNPSLKSRVTISVDTSKNQFSLKLNSVTAADTAVYYCARGYGYFDYWGQGTLVTVSS

SEQ ID NO: 21 - DNA, 336 bp, Artificial Sequence
  Description of Artificial Sequence: Synthetic polynucleotide
caatctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttcgaaggtgttcggcggagggaccaagctgaccgtcctaggt

SEQ ID NO: 22 - DNA, 360 bp, Artificial Sequence
  Description of Artificial Sequence: Synthetic polynucleotide
gaggtgcagctggtggagtctgggggaggtgtggtacggcctggggggtccctgagactctcctgtgcagcctctggattcacctttggtgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccgtatattactgtgcgcgctctaaatacaacttccatgtttactacgattactggggtcaaggtactctggtgaccgtctcctca

SEQ ID NO: 23 - protein, 112 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTSKVFGGGTKLTVLG

SEQ ID NO: 24 - protein, 120 aa, Artificial Sequence
  Description of Artificial Sequence: Synthetic polypeptide
EVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSS

SEQ ID NO: 25 - DNA, 333 bp, Artificial Sequence
  Description of Artificial Sequence: Synthetic polynucleotide
cagtctgtgttgacgcagccaccctcagcgtctgggacccccgggcagacagtcaccatctcttgttctggaagcaactccaacatcggaagtaattatgtatactggtaccagcagctcccaggaacggcccccaaactcctcatctataggaataatcagcggccctcaggggtccctgaccgattctcaggctccaagtctggcacctcagcctccctggccatcagtgggctccgctccgaggatgaggctgattattactgtgcagcatgggatgacagcctgagtgcttatgtcttcggaactgggaccaaggtcaccgtcctaggt

SEQ ID NO: 26 - DNA, 360 bp, Artificial Sequence
  Description of Artificial Sequence: Synthetic polynucleotide
caggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacactgccgtgtattactgtgcgcgctcttctggtaacatggtttcttggaaagatatgtggggtcaaggtactctggtgaccgtctcctca

SEQ ID NO: 27 - protein, 111 aa, Artificial Sequence
  Description of Artificial Sequence: Synthetic polypeptide
QSVLTQPPSASGTPGQTVTISCSGSNSNIGSNYVYWYQQLPGTAPKLLIYRNNQRPSGVPDRFSGSKSGTSASLAISGLRSEDEADYYCAAWDDSLSAYVFGTGTKVTVLG

SEQ ID NO: 28 - protein, 120 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSSGNMVSWKDMWGQGTLVTVSS

SEQ ID NO: 29 - DNA, 336 bp, Artificial Sequence
  Description of Artificial Sequence: Synthetic polynucleotide
caatctgccctgactcagcctgcctccgtgtctgggtctcctggacagtcgatcaccatctcctgcactggaaccagcagtgacgttggtggttataactctgtctcctggtaccaacaacacccaggcaaagcccccagactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacccctttagtcttcggaactgggaccaaggtcaccgtcctaggt

SEQ ID NO: 30 - DNA, 348 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgcggtgctgttgcttaccatgattggggtcaaggtactctggtgaccgtctcctca

SEQ ID NO: 31 - protein, 112 aa, Artificial Sequence
  Description of Artificial Sequence: Synthetic polypeptide
QSALTQPASVSGSPGQSITISCTGTSSDVGGYNSVSWYQQHPGKAPRLMIYDVSNRPSGVSNRFSGSKSGNTASLTISGLQAEDEADYYCSSYTSSSTPLVFGTGTKVTVLG

SEQ ID NO: 32 - protein, 116 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSS

SEQ ID NO: 33 - DNA, 333 bp, Artificial Sequence
  Description of Artificial Sequence: Synthetic polynucleotide
cagtctgtcgtgacgcagccgccctcagtgtctgcggccccaggacagagggtcaccatctcctgctctggaagcagctccaacatttcgatttatgatgtatcctggtatcagcagctcccaggaacagcccccaaactcctcatttatggcaataataagcgaccctcggggattgctgaccgattctctggctccacgtctggcacgtcagccaccctgggcatcaccggactccagactggggacgaggccgattattactgcggaacatgggatgacagtctgagtgggggggtgttcggcggagggaccaagctgaccgtcctaggt

SEQ ID NO: 34 - DNA, 354 bp, Artificial Sequence
  Description of Artificial Sequence: Synthetic polynucleotide
cagatgcagctggtgcaatctggggctgaggtgaagaagcctgggtcctcggtgaaggtctcctgcgaggcttctggaggcaccctcagcagctatgctatcaactgggtgcgacaggcccctggacaagggcttgagtggatgggagggatcatccctatgtttggtacagcacactacgcacagaagttccagggcagagtcacgattaccgcggacgaatccacgaaaacagcctacatggagctgagcagcctgagatctgaggacactgccgtgtattactgtgcgcgcggtgttcattacgcttctttcgatcattggggtcaaggtactctggtgaccgtctcctca

SEQ ID NO: 35 - protein, 111 aa, Artificial Sequence
  Description of Artificial Sequence: Synthetic polypeptide
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLG

SEQ ID NO: 36 - protein, 118 aa, Artificial Sequence
  Description of Artificial Sequence: Synthetic polypeptide
QMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSS

SEQ ID NO: 37 - DNA, 333 bp, Artificial Sequence
  Description of Artificial Sequence: Synthetic polynucleotide
cagtctgtgttgacgcagccgccctcagtgtctgcggccgcaggacagaaggtcaccatctcctgctctggaagcgactccaacattgggaataattatgtgtcctggtatcaacacctcccagggacagcccccaaactcctcatttatgacgttaaaaatcgaccctcagggattcctgaccggttctccggctccaagtctggctcgtcagccaccctaggcatcgccggactccagcctggggacgaggccgattattactgcggaacatgggacagtcggctggatgcctatgtcttcggaactgggaccaaggtcaccgtcctaggt

SEQ ID NO: 38 - DNA, 351 bp, Artificial Sequence
  Description of Artificial Sequence: Synthetic polynucleotide
cagatgcagctggtgcaatctggagctgaggtgaagaagcctggggcctcagtgaaggtctcctgcaagacttctggtttcccctttaatatctttggaatcacctgggtgcgacaggcccctggacaagggcttgagtggatgggatggatcagcggttacaacggtaacacagactacccacagaagttccagggcagagtcaccatgtccacagacacatccacgagtacagcctacatggagctgaggaacctgaaatctgacgacacggccgtgtattactgtgcgcgcggtgcttacggtggtatggatacttggggtcaaggtactctggtgaccgtctcctca

SEQ ID NO: 39 - protein, 111 aa, Artificial Sequence
  Description of Artificial Sequence: Synthetic polypeptide
QSVLTQPPSVSAAAGQKVTISCSGSDSNIGNNYVSWYQHLPGTAPKLLIYDVKNRPSGIPDRFSGSKSGSSATLGIAGLQPGDEADYYCGTWDSRLDAYVFGTGTKVTVLG

SEQ ID NO: 40 - protein, 117 aa, Artificial Sequence
  Description of Artificial Sequence: Synthetic polypeptide
QMQLVQSGAEVKKPGASVKVSCKTSGFPFNIFGITWVRQAPGQGLEWMGWISGYNGNTDYPQKFQGRVTMSTDTSTSTAYMELRNLKSDDTAVYYCARGAYGGMDTWGQGTLVTVSS

SEQ ID NO: 41 - DNA, 336 bp, Artificial Sequence
  Description of Artificial Sequence: Synthetic polynucleotide
cagtctgtcgtgacgcagccgccctcagtgtctggggccccagggcagagggtcaccatctcctgcactgggagcacctccaacatcggggcaggttatgatgtacactggtatcagcagcttccaggaacagcccccaaactcctcatctatactaacaactttcggccctcaggggtccctgaccgattctctgcctccaagtctggcacttcagcttccctggccatcactggtctccaggctgaggatgaggctgattattactgcggaacatgggatagcagcctgagtgccgttgtgttcggcggagggaccaagctgaccgtcctaggt

SEQ ID NO: 42 - DNA, 354 bp, Artificial Sequence
  Description of Artificial Sequence: Synthetic polynucleotide
gaggtgcagctggtggagtctggaactgaggtgaagaagcctggggcctcagtgaaagtctcctgcaaggcttctggttacatgtttaccagttatggtctcaactgggtgcgacaggcccctggacaagggcttgagtggatgggatggatcagcgctaacaatggtaagacaaattatgctaagaaattccaggacagagtcaccatgaccagagacacttccacgagcacaggctacatggaactgaggagcctgagatctgacgacacggccgtatattactgtgcgcgccatatcggtggttcttacttcgatcgttggggtcaaggtactctggtgaccgtctcctca

SEQ ID NO: 43 - protein, 112 aa, Artificial Sequence
  Description of Artificial Sequence: Synthetic polypeptide
QSVVTQPPSVSGAPGQRVTISCTGSTSNIGAGYDVHWYQQLPGTAPKLLIYTNNFRPSGVPDRFSASKSGTSASLAITGLQAEDEADYYCGTWDSSLSAVVFGGGTKLTVLG

SEQ ID NO: 44 - protein, 118 aa, Artificial Sequence
  Description of Artificial Sequence: Synthetic polypeptide
EVQLVESGTEVKKPGASVKVSCKASGYMFTSYGLNWVRQAPGQGLEWMGWISANNGKTNYAKKFQDRVTMTRDTSTSTGYMELRSLRSDDTAVYYCARHIGGSYFDRWGQGTLVTVSS

SEQ ID NO: 45 - DNA, 327 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcattatgtcttcggaactgggaccaaggtcaccgtcctaggt

SEQ ID NO: 46 - DNA, 357 bp, Artificial Sequence
  Description of Artificial Sequence: Synthetic polynucleotide
gaggtgcagctggtggagactgggggaggcttggtacagcctggggggtccctgagactctcctgtgcagcctctggattcacctttagcagctatgccatgagctgggtccgccaggctccagggaaggggctggagtgggtctcagctattagtggtagtgatggtagcacatactacgcagactccgtgaagggccggttcaccatctccagagacaattccaagaacacgctgtatctgcaaatgaacagcctgagagacgaggacacggccgtatattactgtgcgcgctctcatgaagctaacctggttggtgattggtggggtcaaggtactctggtgaccgtctcctca

SEQ ID NO: 47 - protein, 109 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKVTVLG

SEQ ID NO: 48 - protein, 119 aa, Artificial Sequence
  Description of Artificial Sequence: Synthetic polypeptide
EVQLVETGGGLVQPGGSLRLSCAASGFTFSSYAMSWVRQAPGKGLEWVSAISGSDGSTYYADSVKGRFTISRDNSKNTLYLQMNSLRDEDTAVYYCARSHEANLVGDWWGQGTLVTVSS

SEQ ID NO: 49 - DNA, 324 bp, Artificial Sequence
  Description of Artificial Sequence: Synthetic polynucleotide
cagtctgtggtgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatgtggtattcggcggagggaccaagctgaccgtcctaggt

SEQ ID NO: 50 - DNA, 354 bp, Artificial Sequence
  Description of Artificial Sequence: Synthetic polynucleotide
gaggtccagctggtacagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgctggggtggtttcggtgctgttgatcattggggtcaaggtactctggtgaccgtctcctca

SEQ ID NO: 51 - protein, 108 aa, Artificial Sequence
  Description of Artificial Sequence: Synthetic polypeptide
QSVVTQPPSVSVAPGKTARITCGGNNIGSKSVHWYQQKPGQAPVLVIYYDSDRPSGIPERFSGSNSGNTATLTISRVEAGDEADYYCQVWDSSSDVVFGGGTKLTVLG

SEQ ID NO: 52 - protein, 118 aa, Artificial Sequence
  Description of Artificial Sequence: Synthetic polypeptide
EVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARWGGFGAVDHWGQGTLVTVSS

SEQ ID NO: 53 - DNA, 327 bp, Artificial Sequence
  Description of Artificial Sequence: Synthetic polynucleotide
tcttctgagctgactcaggaccctgctgtgtctgtggccttgggacagacagtcaagatcacgtgccaaggagacagcctcacagactaccatgcaacctggtaccagcagaagccaggacaggcccctgtcgctgtcatctatgctacaaacaaccggcccactgggatcccagaccgattctctggttccagttccggaaacacagcttctttgaccatcactggggctcaggcggaagatgaggctgactattactgtaattcccgggacagcggcacggacgaagtgttattcggcggagggaccaagctgaccgtcctaggt

SEQ ID NO: 54 - DNA, 345 bp, Artificial Sequence
  Description of Artificial Sequence: Synthetic polynucleotide
gaggtgcagctggtggagactgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggccgtgtattactgtgcgcgcggtcagggttacgattactggggtcaaggtactctggtgaccgtctcctca

SEQ ID NO: 55 - protein, 109 aa, Artificial Sequence
  Description of Artificial Sequence: Synthetic polypeptide
SSELTQDPAVSVALGQTVKITCQGDSLTDYHATWYQQKPGQAPVAVIYATNNRPTGIPDRFSGSSSGNTASLTITGAQAEDEADYYCNSRDSGTDEVLFGGGTKLTVLG

SEQ ID NO: 56 - protein, 115 aa, Artificial Sequence
  Description of Artificial Sequence: Synthetic polypeptide
EVQLVETGGGLVKPGGSLRLSCAASGFTFSSYSMNWVRQAPGKGLEWVSSISSSSSYIYYADSVKGRFTISRDNAKNSLYLQMNSLRAEDTAVYYCARGQGYDYWGQGTLVTVSS

SEQ ID NO: 57 - DNA, 327 bp, Artificial Sequence
  Description of Artificial Sequence: Synthetic polynucleotide
tcctatgtgctgactcagccaccctcggtgtcagtggccccaggaaagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgagcatcagcagggtcgaagccggggatgaggccgactattactgtcaggtgtgggatagtagtagtgatcatactgtcttcggaactgggaccaaggtcaccgtcctaggt

SEQ ID NO: 58 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgctactacccgggtatggatatgtggggtcaaggtactctggtgaccgtctcctca

SEQ ID NO: 59 - protein, 109 aa, Artificial Sequence
  Description of Artificial Sequence: Synthetic polypeptide
SYVLTQPPSVSVAPGKTARITCGGNNIGSKSVHWYQQKPGQAPVLVVYDDSDRPSGIPERFSGSNSGNTATLSISRVEAGDEADYYCQVWDSSSDHTVFGTGTKVTVLG

SEQ ID NO: 60 - protein, 115 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARYYPGMDMWGQGTLVTVSS

SEQ ID NO: 61 - DNA, 333 bp, Artificial Sequence
  Description of Artificial Sequence: Synthetic polynucleotide
caggctgtgctgactcagccgccctcaacgtctgggacccccgggcagagggtcaccatctcttgttctggaagcagctccaacatcgggagaaatggtgtaaactggtaccagcagctcccaggagcggcccccaaagtcctcatctataatgataatcagcgaccctcaggggtccctgaccgagtctctggctcccagtctggctcctcaggcaccctggccatcgatgggcttcggtctgaggatgaggctgattattactgtgcggcatgggatgacagcctgcatggtgtggtattcggcggagggaccaagctgaccgtcctaggt

SEQ ID NO: 62 - DNA, 345 bp, Artificial Sequence
  Description of Artificial Sequence: Synthetic polynucleotide
caggtccagctggtacagtctggggctgaggtgaagaagcctggggcctcagtgaaggtctcctgcaaggtttccggatacaccctcaatgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgcggtggttacggtgattcttggggtcaaggtactctggtgaccgtctcctca

SEQ ID NO: 63 - protein, 111 aa, Artificial Sequence
  Description of Artificial Sequence: Synthetic polypeptide
QAVLTQPPSTSGTPGQRVTISCSGSSSNIGRNGVNWYQQLPGAAPKVLIYNDNQRPSGVPDRVSGSQSGSSGTLAIDGLRSEDEADYYCAAWDDSLHGVVFGGGTKLTVLG

SEQ ID NO: 64 - protein, 115 aa, Artificial Sequence
  Description of Artificial Sequence: Synthetic polypeptide
QVQLVQSGAEVKKPGASVKVSCKVSGYTLNELSMHWVRQAPGKGLEWMGGFDPEDGETIYAQKFQGRVTMTEDTSTDTAYMELSSLRSEDTAVYYCARGGYGDSWGQGTLVTVSS

SEQ ID NO: 65 - DNA, 336 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattcttgggtgttcggcggagggaccaagctgaccgtcctaggt

SEQ ID NO: 66 - DNA, 396 bp, Artificial Sequence
  Description of Artificial Sequence: Synthetic polynucleotide
caggtgcagctggtgcaatctggggctgaggtgaagaggcctgggtcctcggtgaaggtctcctgcacggcttctggaggcaccttcagcagcgatgctatcagctgggtgcgacaggcccctggacaagggcttgagtggatgggaggaatcatccctatgtttggtacagcaaactacgcacagaagttccagggcagagtcacgattaccgcggacgaatccacgagcacagcctacatggagctgagcagcctgagatctgaggacacggccgtgtattactgtgcgcgcgaaggttactactacccgtctgcttacctgggttctgttctgaacgacatctcttctgtttacgatgaatggggtcaaggtactctggtgaccgtctcctca

SEQ ID NO: 67 - protein, 112 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSWVFGGGTKLTVLG

SEQ ID NO: 68 - protein, 132 aa, Artificial Sequence
  Description of Artificial Sequence: Synthetic polypeptide
QVQLVQSGAEVKRPGSSVKVSCTASGGTFSSDAISWVRQAPGQGLEWMGGIIPMFGTANYAQKFQGRVTITADESTSTAYMELSSLRSEDTAVYYCAREGYYYPSAYLGSVLNDISSVYDEWGQGTLVTVSS

SEQ ID NO: 69 - DNA, 336 bp, Artificial Sequence
  Description of Artificial Sequence: Synthetic polynucleotide
cagtctgtcgtgacgcagccgccctcagtgtctgcggccccaggacagaaggtcaccatctcctgctctggaagcacctccaacattggaaataatgatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcgtgagtgcttcttgggtcttcggcagagggaccaagctgaccgtcctaggt

SEQ ID NO: 70 - DNA, 348 bp, Artificial Sequence
  Description of Artificial Sequence: Synthetic polynucleotide
caggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatccacagaagctccagggcagagtcaccatgaccacagacccatccacgagcacagcctacatggagctgaggagcctgagatctgacgacacggccgtgtattactgtgcgcgctctatgacttctttcgattactggggtcaaggtactctggtgaccgtctcctca

SEQ ID NO: 71 - protein, 112 aa, Artificial Sequence
  Description of Artificial Sequence: Synthetic polypeptide
QSVVTQPPSVSAAPGQKVTISCSGSTSNIGNNDVSWYQQLPGTAPKLLIYDNNKRPSGIPDRFSGSKSGTSATLGITGLQTGDEADYYCGTWDSSVSASWVFGRGTKLTVLG

SEQ ID NO: 72 - protein, 116 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYPQKLQGRVTMTTDPSTSTAYMELRSLRSDDTAVYYCARSMTSFDYWGQGTLVTVSS

SEQ ID NO: 73 - DNA, 336 bp, Artificial Sequence
  Description of Artificial Sequence: Synthetic polynucleotide
cagtctgtgttgacgcagccgccctcagtgtctgcggccccaggacagaaggtcaccatctcctgctctggaagcaactccaacattgggaataattatgtatcctggtatcagcaactcccagggacagcccccaaactcctcatttatgacaataataagcgaccctcagggattcctgaccgattctctggctccaggtctggcacgtcagccaccctgggcatcaccggactccagactggggacgaggccgattattactgcggaacatggaataccactgtgactcctggctatgtcttcggaactgggaccaaggtcaccgtcctaggt

SEQ ID NO: 74 - DNA, 348 bp, Artificial Sequence
  Description of Artificial Sequence: Synthetic polynucleotide
gaagtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacaccgccatgtattactgtgcgcgctctgtttacgacctggatacttggggtcaaggtactctggtgaccgtctcctca

SEQ ID NO: 75 - protein, 112 aa, Artificial Sequence
  Description of Artificial Sequence: Synthetic polypeptide
QSVLTQPPSVSAAPGQKVTISCSGSNSNIGNNYVSWYQQLPGTAPKLLIYDNNKRPSGIPDRFSGSRSGTSATLGITGLQTGDEADYYCGTWNTTVTPGYVFGTGTKVTVLG

SEQ ID NO: 76 - protein, 116 aa, Artificial Sequence
  Description of Artificial Sequence: Synthetic polypeptide
EVQLVQSGAEVKKPGASVKVSCKASGYTFTSYGISWVRQAPGQGLEWMGWISAYNGNTNYAQKLQGRVTMTTDTSTSTAYMELRSLRSDDTAMYYCARSVYDLDTWGQGTLVTVSS

SEQ ID NO: 77 - DNA, 336 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgggggccccttatgtcttcggaactgggaccaaggtcaccgtcctaggt

SEQ ID NO: 78 - DNA, 357 bp, Artificial Sequence
  Description of Artificial Sequence: Synthetic polynucleotide
gaggtgcagctggtgcagtcttggggaggctcggaacagcctggcaggtccctgagactctcctgtgcagcctctggattcacctttgatgattatgccatgcactgggtccggcaagctccagggaagggcctggagtgggtctcaggtattagttggaatagcggtagcataggctatgcggactctgtgaagggccgattcaccatctccagagacaacgccaagaattccctgtatctgcaaatgaacagtctgagagctgaggacaccgccatgtattactgtgcgcgctaccgtcaggttggttctgcttacgattcttggggtcaaggtactctggtgaccgtctcctca

SEQ ID NO: 79 - protein, 112 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLGAPYVFGTGTKVTVLG

SEQ ID NO: 80 - protein, 119 aa, Artificial Sequence
  Description of Artificial Sequence: Synthetic polypeptide
EVQLVQSWGGSEQPGRSLRLSCAASGFTFDDYAMHWVRQAPGKGLEWVSGISWNSGSIGYADSVKGRFTISRDNAKNSLYLQMNSLRAEDTAMYYCARYRQVGSAYDSWGQGTLVTVSS

SEQ ID NO: 81 - DNA, 330 bp, Artificial Sequence
  Description of Artificial Sequence: Synthetic polynucleotide
ctgcctgtgctgactcagccaccctcggtgtcagtggccccaggaaagacggccaggattacctgtgggggaaacaacattggaagtaaaagtgtgcactggtatcagcagaagccaggccaggcccctgtgctggtcgtctatgctgatagcgaccggccctcagggatccctgagcgattctctggctccaactctgggaacacggccaccctgaccatcagcagggtcgaagccggggatgaggccgactattactgtcaggtgtgggatagtagtagttatcataattatgtcttcggaactgggaccaaggtcaccgtcctaggt

SEQ ID NO: 82 - DNA, 354 bp, Artificial Sequence
  Description of Artificial Sequence: Synthetic polynucleotide
gaggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgaggacaccgccatgtattactgtgcgcgctactggggtttcggtgtttctgatcgttggggtcaaggtactctggtgaccgtctcctca

SEQ ID NO: 83 - protein, 110 aa, Artificial Sequence
  Description of Artificial Sequence: Synthetic polypeptide
LPVLTQPPSVSVAPGKTARITCGGNNIGSKSVHWYQQKPGQAPVLVVYADSDRPSGIPERFSGSNSGNTATLTISRVEAGDEADYYCQVWDSSSYHNYVFGTGTKVTVLG

SEQ ID NO: 84 - protein, 118 aa, Artificial Sequence
  Description of Artificial Sequence: Synthetic polypeptide
EVQLVQSGAEVKKPGASVKVSCKASGYTFTSYGISWVRQAPGQGLEWMGWISAYNGNTNYAQKLQGRVTMTTDTSTSTAYMELSSLRSEDTAMYYCARYWGFGVSDRWGQGTLVTVSS

SEQ ID NO: 85 - DNA, 336 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccccgatcggttctctggctccatcgacagctcctccaactctgcctccctcaccatctctggactgaagactgaggacgaggctgactactactgtcagtcttatgacagcagcaatctttgggtgttcggcggagggaccaagctgaccgtcctaggt

SEQ ID NO: 86 - DNA, 351 bp, Artificial Sequence
  Description of Artificial Sequence: Synthetic polynucleotide
cagatgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgctacaactactactactacgattcttggggtcaaggtactctggtgaccgtctcctca

SEQ ID NO: 87 - protein, 112 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNLWVFGGGTKLTVLG

SEQ ID NO: 88 - protein, 117 aa, Artificial Sequence
  Description of Artificial Sequence: Synthetic polypeptide
QMQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYYYDSWGQGTLVTVSS

SEQ ID NO: 89 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaacgt

SEQ ID NO: 90 - DNA, 354 bp, Artificial Sequence
  Description of Artificial Sequence: Synthetic polynucleotide
gaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacaccgccatgtattactgtgcgcgctactggggttacgactcttacgatgaatggggtcaaggtactctggtgaccgtctcctca

SEQ ID NO: 91 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKR

SEQ ID NO: 92 - protein, 118 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAMYYCARYWGYDSYDEWGQGTLVTVSS

SEQ ID NO: 93 - DNA, 333 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggt

SEQ ID NO: 94 - DNA, 351 bp, Artificial Sequence
  Description of Artificial Sequence: Synthetic polynucleotide
gaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgcaacaaccattactacaacgattactggggtcaaggtactctggtgaccgtctcctca

SEQ ID NO: 95 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVLG

SEQ ID NO: 96 - protein, 117 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARNNHYYNDYWGQGTLVTVSS

SEQ ID NO: 97 - DNA, 336 bp, Artificial Sequence
  Description of Artificial Sequence: Synthetic polynucleotide
cagtctgtgttgacgcagccgccctcagtgtctggggccccagggcagggggtcaccatcccctgcactgggagcagctccaacatcggggcaggttatgatgtacactggtaccagcagcttccagggacagcccccaaactcctcatctatggtaacaacaatcggccctcaggggtccctgaccgcttctctggctccaggtctggctcctcagcctccctggccatcactgggctccaggctgaggatgaggctgattattactgccagtcctatgacagcagcctgagtgatgtggtattcggcggagggaccaaggtcaccgtcctaggt

SEQ ID NO: 98 - DNA, 378 bp, Artificial Sequence
  Description of Artificial Sequence: Synthetic polynucleotide
gaggtccagctggtgcagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcgcgctactggtcttactctttcgactacctgtacatgccggaaggtaacgattggtggggtcaaggtactctggtgaccgtctcctca

SEQ ID NO: 99 - protein, 112 aa, Artificial Sequence
  Description of Artificial Sequence: Synthetic polypeptide
QSVLTQPPSVSGAPGQGVTIPCTGSSSNIGAGYDVHWYQQLPGTAPKLLIYGNNNRPSGVPDRFSGSRSGSSASLAITGLQAEDEADYYCQSYDSSLSDVVFGGGTKVTVLG

SEQ ID NO: 100 - protein, 126 aa, Artificial Sequence
  Description of Artificial Sequence: Synthetic polypeptide
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCARYWSYSFDYLYMPEGNDWWGQGTLVTVSS

SEQ ID NO: 101 - DNA, 333 bp, Artificial Sequence
  Description of Artificial Sequence: Synthetic polynucleotide
cagtctgtgttgactcagccacccgcagcgtctgggacccccggacagagagtcaccatctcttgttctgggggcgtctccaacatcgggagtggtgctctaaattggtaccagcaactcccaggaacggcccccaaactcctcatctatagttacaatcagcggccctcaggggtctctgaccgattctctggctccaggtctgccacctcagcctccctggccatcagtgggctccagtctgaggatgaggctgattattactgtgcaacctgggatgatagtgtgaatggttgggtgttcggcggagggaccaagctgaccgtcctaggt

SEQ ID NO: 102 - DNA, 357 bp, Artificial Sequence
  Description of Artificial Sequence: Synthetic polynucleotide
caggtccagctggtacagtctggagctgaggtgaagaagcctggggattcagtgaaggtctcctgcaagccttctggttacaattttctcaactatggtatcaactgggtgcgacaggcccctggacaagggcttgagtggatgggatggattagcacttacaccggtaacacaaactatgcacagaagctgcagggcagagtcaccttcaccacagacacatccacgagcacagcctacatggagatgaggagcctgagatctgacgacacggccgtgtattactgtgcgcgcgacctgtactactacgaaggtgttgattactggggtcaaggtactctggtgaccgtctcctca

SEQ ID NO: 103 - protein, 111 aa, Artificial Sequence
  Description of Artificial Sequence: Synthetic polypeptide
QSVLTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLG

SEQ ID NO: 104 - protein, 119 aa, Artificial Sequence
  Description of Artificial Sequence: Synthetic polypeptide
QVQLVQSGAEVKKPGDSVKVSCKPSGYNFLNYGINWVRQAPGQGLEWMGWISTYTGNTNYAQKLQGRVTFTTDTSTSTAYMEMRSLRSDDTAVYYCARDLYYYEGVDYWGQGTLVTVSS

SEQ ID NO: 105 - DNA, 327 bp, Artificial Sequence
  Description of Artificial Sequence: Synthetic polynucleotide
caggctgtgctgactcagccaccctcagtgtcagtggccccaggaaagacggccagggttacctgtgggggaaacaacattggaagtgaaagtgtgcactggtaccagcagaagccaggccaggcccctgtgttggtcatctattatgataccgaccggccctcagggatccctgagcgattctctggctcccactctgggaccacggccaccctgaccatcagcagggtcgaagccggggatgaggccgactattactgtcaggtgtgggatagtagtagggatcatgtggtattcggcggagggaccaagctgaccgtcctaggt

SEQ ID NO: 106 - DNA, 357 bp, Artificial Sequence
  Description of Artificial Sequence: Synthetic polynucleotide
caggtgcagctggtgcagtctgggggaggcgtggtccagcctgggaggtccctgagactctcctgtgcggcctctggattcaccttcagtagctatgctatgcactgggtccgccaggctccaggcaagggactggagtgggtggcagttatatcatatgatggaagcaataaatactacgcagactccgtgaagggcctattcaccatctccagagacaattccaagaacacgctgtatctgcaaatgaacagcctgagagctgaggacacggccgtgtattactgtgcgcgctcttacttcacttctggtttctacgattactggggtcaaggtactctggtgaccgtctcctca

SEQ ID NO: 107 - protein, 109 aa, Artificial Sequence
  Description of Artificial Sequence: Synthetic polypeptide
QAVLTQPPSVSVAPGKTARVTCGGNNIGSESVHWYQQKPGQAPVLVIYYDTDRPSGIPERFSGSHSGTTATLTISRVEAGDEADYYCQVWDSSRDHVVFGGGTKLTVLG

SEQ ID NO: 108 - protein, 119 aa, Artificial Sequence
  Description of Artificial Sequence: Synthetic polypeptide
QVQLVQSGGGVVQPGRSLRLSCAASGFTFSSYAMHWVRQAPGKGLEWVAVISYDGSNKYYADSVKGLFTISRDNSKNTLYLQMNSLRAEDTAVYYCARSYFTSGFYDYWGQGTLVTVSS

SEQ ID NO: 109 - DNA, 339 bp, Artificial Sequence
  Description of Artificial Sequence: Synthetic polynucleotide
cagtctgtcgtgacgcagccgccctcagtgtctggggccccagggcagagggtcaccatctcctgcactgggagcagttccaacatcggggcaggttatgatgtaaattggtatcagcagtttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggctcttatgtcttcggaactgggaccaaggtcaccgtcctaggt

SEQ ID NO: 110 - DNA, 348 bp, Artificial Sequence
  Description of Artificial Sequence: Synthetic polynucleotide
cagatgcagctggtgcagtctggggctgaggtgaagaagcctggggcctcagtgaaggtctcctgcaaggcttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgcatgtcttctatgtactacgattggggtcaaggtactctggtgaccgtctcctca

SEQ ID NO: 111 - protein, 113 aa, Artificial Sequence
  Description of Artificial Sequence: Synthetic polypeptide
QSVVTQPPSVSGAPGQRVTISCTGSSSNIGAGYDVNWYQQFPGTAPKLLIYGNSNRPSGVPDRFSGSKSGTSASLAITGLQAEDEADYYCQSYDSSLSGSYVFGTGTKVTVLG

SEQ ID NO: 112 - protein, 116 aa, Artificial Sequence
  Description of Artificial Sequence: Synthetic polypeptide
QMQLVQSGAEVKKPGASVKVSCKASGYTLTELSMHWVRQAPGKGLEWMGGFDPEDGETIYAQKFQGRVTMTEDTSTDTAYMELSSLRSEDTAVYYCARMSSMYYDWGQGTLVTVSS

SEQ ID NO: 113 - DNA, 324 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgattatgtcttcggaactgggaccaaggtcaccgtcctaggt

SEQ ID NO: 114 - DNA, 345 bp, Artificial Sequence
  Description of Artificial Sequence: Synthetic polynucleotide
gaggtgcagctggtggagactgggggaggcttggtcaagcctggagggtccctgagactctcctgtgcagcctctggattcaccgtcagtgactactacatgagctggatccgccaggctccagggaagggcctggagtggatttcatacattagtggtagtggtaatagcatatactacgcagactctgtgaagggccgattcaccatctccagggacaacgccaagaactcactggatctgcaaatgaccagcctgagagccgaggacacggccgtatattactgtgcgcgctctactaaattcgattactggggtcaaggtactctggtgaccgtctcctca

SEQ ID NO: 115 - protein, 108 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDYVFGTGTKVTVLG

SEQ ID NO: 116 - protein, 115 aa, Artificial Sequence
  Description of Artificial Sequence: Synthetic polypeptide
EVQLVETGGGLVKPGGSLRLSCAASGFTVSDYYMSWIRQAPGKGLEWISYISGSGNSIYYADSVKGRFTISRDNAKNSLDLQMTSLRAEDTAVYYCARSTKFDYWGQGTLVTVSS

SEQ ID NO: 117 - DNA, 333 bp, Artificial Sequence
  Description of Artificial Sequence: Synthetic polynucleotide
ctgcctgtgctgactcagccaccctcagcgtctgggacccccgggcagagggtcaccatctcttgttctggaagcagctccaacgtcggaagttacactgtaaactggtaccggcaactcccaggaacggcccccacactcctcatctataataataatcagcggccctcaggggtccctgaccgattctctgactccaagtctggcacctcggcctccctgaccattagtgggctccagcctgaggatgaggctgattattattgtgcagcatgggatgacaggctgggtggttatgtcttcggaactgggaccaaggtcaccgtcctaggt

SEQ ID NO: 118 - DNA, 357 bp, Artificial Sequence
  Description of Artificial Sequence: Synthetic polynucleotide
gaggtgcagctggtgcagtctggagcagaggtgaaaaagccgggggagtctctgaagatctcctgtaagggttctggatacagctttaccaactactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctacagtggagcagcctgaaggcctcggacaccgccatgtattactgtgcgcgctctactggttcttctcatatgtctgatgaatggggtcaaggtactctggtgaccgtctcctca

SEQ ID NO: 119 - protein, 111 aa, Artificial Sequence
  Description of Artificial Sequence: Synthetic polypeptide
LPVLTQPPSASGTPGQRVTISCSGSSSNVGSYTVNWYRQLPGTAPTLLIYNNNQRPSGVPDRFSDSKSGTSASLTISGLQPEDEADYYCAAWDDRLGGYVFGTGTKVTVLG

SEQ ID NO: 120 - protein, 119 aa, Artificial Sequence
  Description of Artificial Sequence: Synthetic polypeptide
EVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARSTGSSHMSDEWGQGTLVTVSS

SEQ ID NO: 121 - DNA, 336 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcattgggtgttcggcggagggaccaagctgaccgtcctaggt

SEQ ID NO: 122 - DNA, 345 bp, Artificial Sequence
  Description of Artificial Sequence: Synthetic polynucleotide
caagtgcagctacagcagtggggcgcaggactgttgaagccttcggagaccctgtccctcacctgcgctgtctatggtgggtccttcagtggttactactggagctggatccgccagcccccagggaaggggctggagtggattggggagatcactcatagtggaaggtccaactacaacccgtccctcaagagtcgagtcaccatatcagtagacacgtccaagaaccagttctccctgaagctgagctctgtgaccgccgcggacacggccgtgtattactgtgcgcgctcttctatcatgtctgattactggggtcaaggtactctggtgaccgtctcctca

SEQ ID NO: 123 - protein, 112 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVLG

SEQ ID NO: 124 - protein, 115 aa, Artificial Sequence
  Description of Artificial Sequence: Synthetic polypeptide
QVQLQQWGAGLLKPSETLSLTCAVYGGSFSGYYWSWIRQPPGKGLEWIGEITHSGRSNYNPSLKSRVTISVDTSKNQFSLKLSSVTAADTAVYYCARSSIMSDYWGQGTLVTVSS

SEQ ID NO: 125 - DNA, 336 bp, Artificial Sequence
  Description of Artificial Sequence: Synthetic polynucleotide
cagtctgtgttgacgcagccgccctcagtgtctggggccccagggcagagggtcaccatctcctgcactgggagcacctccaacatcggggcaggttatgatgtacactggtaccagcagcttccaggaacagcccccaaactcctcatcaacaataacaggaatcggccctcaggggtccctgaccgattctctggctccaagtctggcacgtcagccaccctgggcatcaccggactccagactggggacgaggccgattattactgcggaacatgggatggcagcctgactggtgcagtgttcggcggagggaccaagctgaccgtcctaggt

SEQ ID NO: 126 - DNA, 354 bp, Artificial Sequence
  Description of Artificial Sequence: Synthetic polynucleotide
gaggtccagctggtgcagtctggggctgaggtgaagaagcctgggtcctcggtgaaggtctcatgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgcggttctgctctggaccattacgatcgttggggtcaaggtactctggtgaccgtctcctca

SEQ ID NO: 127 - protein, 112 aa, Artificial Sequence
  Description of Artificial Sequence: Synthetic polypeptide
QSVLTQPPSVSGAPGQRVTISCTGSTSNIGAGYDVHWYQQLPGTAPKLLINNNRNRPSGVPDRFSGSKSGTSATLGITGLQTGDEADYYCGTWDGSLTGAVFGGGTKLTVLG

SEQ ID NO: 128 - protein, 118 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGSALDHYDRWGQGTLVTVSS

SEQ ID NO: 129 - DNA, 333 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaccaattgggtgttcggcggagggaccaagctgaccgtcctaggt

SEQ ID NO: 130 - DNA, 351 bp, Artificial Sequence
  Description of Artificial Sequence: Synthetic polynucleotide
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgctacaactactacttcaacgattactggggtcaaggtactctggtgaccgtctcctca

SEQ ID NO: 131 - protein, 111 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSTNWVFGGGTKLTVLG

SEQ ID NO: 132 - protein, 117 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYFNDYWGQGTLVTVSS

SEQ ID NO: 133 - DNA, 330 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggt

SEQ ID NO: 134 - DNA, 351 bp, Artificial Sequence
  Description of Artificial Sequence: Synthetic polynucleotide
cagatgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacactgccgtgtattactgtgcgcgctctatgttcggtgctcatgattcttggggtcaaggtactctggtgaccgtctcctca

SEQ ID NO: 135 - protein, 110 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPYVFGTGTKVTVLG

SEQ ID NO: 136 - protein, 117 aa, Artificial Sequence
  Description of Artificial Sequence: Synthetic polypeptide
QMQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSMFGAHDSWGQGTLVTVSS

SEQ ID NO: 137 - DNA, 336 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacatcggggcaggttttgatgtacactggtaccagctacttccaggaacagcccccaaactcctcatctatgctaacagcaatcggccctcaggggtccctgaccgattctctggctccaagtctggcacctcagcctccctggccatcactgggctcctggctgaggatgaggctgattattactgccagtcctatgacagcagcctgagtggtgtggtattcggcggagggaccaagctgaccgtcctaggt

SEQ ID NO: 138 - DNA, 354 bp, Artificial Sequence
  Description of Artificial Sequence: Synthetic polynucleotide
caggtgcagctggtgcaatctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgcggtgcttctttcgaccgtcatgataactggggtcaaggtactctggtgaccgtctcctca

SEQ ID NO: 139 - protein, 112 aa, Artificial Sequence
  Description of Artificial Sequence: Synthetic polypeptide
QSVLTQPPSVSGAPGQRVTISCTGSSSNIGAGFDVHWYQLLPGTAPKLLIYANSNRPSGVPDRFSGSKSGTSASLAITGLLAEDEADYYCQSYDSSLSGVVFGGGTKLTVLG

SEQ ID NO: 140 - protein, 118 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGASFDRHDNWGQGTLVTVSS

SEQ ID NO: 141 - DNA, 333 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggt

SEQ ID NO: 142 - DNA, 351 bp, Artificial Sequence
  Description of Artificial Sequence: Synthetic polynucleotide
gaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgctctaactactactacaacgattactggggtcaaggtactctggtgaccgtctcctca

SEQ ID NO: 143 - protein, 111 aa, Artificial Sequence
  Description of Artificial Sequence: Synthetic polypeptide
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVLG

SEQ ID NO: 144 - protein, 117 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSNYYYNDYWGQGTLVTVSS

SEQ ID NO: 145 - DNA, 336 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtcctaggt

SEQ ID NO: 146 - DNA, 348 bp, Artificial Sequence
  Description of Artificial Sequence: Synthetic polynucleotide
caggtgcagctggtgcagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgctactctggtgtttactacgattggggtcaaggtactctggtgaccgtctcctca

SEQ ID NO: 147 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLG

SEQ ID NO: 148 - protein, 116 aa, Artificial Sequence
  Description of Artificial Sequence: Synthetic polypeptide
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCARYSGVYYDWGQGTLVTVSS

SEQ ID NO: 149 - DNA, 336 bp, Artificial Sequence
  Description of Artificial Sequence: Synthetic polynucleotide
aattttatgctgactcagccccactctgtgtcggggtctccggggaagacggtaaccatctcctgcaccggcagcagtggcagcattgccgacaactttgtgcagtggtaccagcagcgcccgggcggtgtccccaccactgtgatctttaatgatgacgaaagaccctctggcgtccctgatcggttctctggctccatcgacacctcctccaattctgcctccctcaccatctctggactgaagactgaggacgaggctgactactactgtcagtcttatgataataataatcgaggggtgttcggcggagggaccaagctgaccgtcctaggt

SEQ ID NO: 150 - DNA, 348 bp, Artificial Sequence
  Description of Artificial Sequence: Synthetic polynucleotide
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatgaaccctaacagtggtaacacaggctatgcacagaagttccagggcagagtcaccatgaccaggaacacctccataagcacagcctacatggagctgagcaacctgagatctgaggacacggccgtgtattactgtgcgcgctactactcttacggttacgattggggtcaaggtactctggtgaccgtctcctca

SEQ ID NO: 151 - protein, 112 aa, Artificial Sequence
  Description of Artificial Sequence: Synthetic polypeptide
NFMLTQPHSVSGSPGKTVTISCTGSSGSIADNFVQWYQQRPGGVPTTVIFNDDERPSGVPDRFSGSIDTSSNSASLTISGLKTEDEADYYCQSYDNNNRGVFGGGTKLTVLG

SEQ ID NO: 152 - protein, 116 aa, Artificial Sequence
  Description of Artificial Sequence: Synthetic polypeptide
QVQLVQSGAEVKKPGSSVKVSCKASGGTFSSYAISWVRQAPGQGLEWMGWMNPNSGNTGYAQKFQGRVTMTRNTSISTAYMELSNLRSEDTAVYYCARYYSYGYDWGQGTLVTVSS

SEQ ID NO: 153 - DNA, 336 bp, Artificial Sequence
  Description of Artificial Sequence: Synthetic polynucleotide
cagtctgtcgtgacgcagccgccctcagtgtctggggccccagggcagacggtcaccatctcctgcactgggggcagctccaacatcgggacaggttattttgtaaattggtaccagcaggttccaggaaaagcccccaaactcctcatcctgggtaacaataatcggccctcgggggtccctgaccgactctccggctccacgtccggcacctcagcctccctggccatcactgggctccaggctgaggatgagggtacttattactgccagtcctatgacagcagcctgagtggttatgtcttcggaactgggaccaaggtcaccgtcctaggt

SEQ ID NO: 154 - DNA, 366 bp, Artificial Sequence
  Description of Artificial Sequence: Synthetic polynucleotide
caggtacagctgcagcagtcaggtccaggactggtgaagccctcgcagaccctctcactcacctgtggcatctccggggacagtgtctctaccaacagtgttgcttggcactggatcaggcagtccccatcgagaggccttgagtggctgggaaggacatactacaggtccaagtggtctaatgactatggagtatctgtgaaaagtcgaatcaccatcatcccagacacatccaagaaccagttctccctgcagctgaactctgtgactcccgaggacacggctgtgtattactgtgcgcgctcttcttcttggtaccagatcttcgattactggggtcaaggtactctggtgaccgtctcctca

SEQ ID NO: 155 - protein, 112 aa, Artificial Sequence
  Description of Artificial Sequence: Synthetic polypeptide
QSVVTQPPSVSGAPGQTVTISCTGGSSNIGTGYFVNWYQQVPGKAPKLLILGNNNRPSGVPDRLSGSTSGTSASLAITGLQAEDEGTYYCQSYDSSLSGYVFGTGTKVTVLG

SEQ ID NO: 156 - protein, 122 aa, Artificial Sequence
  Description of Artificial Sequence: Synthetic polypeptide
QVQLQQSGPGLVKPSQTLSLTCGISGDSVSTNSVAWHWIRQSPSRGLEWLGRTYYRSKWSNDYGVSVKSRITIIPDTSKNQFSLQLNSVTPEDTAVYYCARSSSWYQIFDYWGQGTLVTVSS

SEQ ID NO: 157 - DNA, 336 bp, Artificial Sequence
  Description of Artificial Sequence: Synthetic polynucleotide
aattttatgctgactcagccccactctgtgtcggagtctccggggaagacggtaaccatctcctgcaccggcagcagcgacagcatagccaacaactatgttcagtggtaccagcagcgcccgggcagtgcccccaccaatgtgatctacgaagatgtccaaagaccctctggggtccctgatcggttctctgggtccatcgacagctcctccaactctgcctccctcaccatctctggactgaagactgaggacgaggctgtctactattgtcagtcttatcatagcgacaatcgttgggtgttcggcggcgggaccaagctgaccgtcctaggt

SEQ ID NO: 158 - DNA, 363 bp, Artificial Sequence
  Description of Artificial Sequence: Synthetic polynucleotide
caggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgcgctctggtgcttactgggactactctgtttacgatgaatggggtcaaggtactctggtgaccgtctcctca

SEQ ID NO: 159 - protein, 112 aa, Artificial Sequence
  Description of Artificial Sequence: Synthetic polypeptide
NFMLTQPHSVSESPGKTVTISCTGSSDSIANNYVQWYQQRPGSAPTNVIYEDVQRPSGVPDRFSGSIDSSSNSASLTISGLKTEDEAVYYCQSYHSDNRWVFGGGTKLTVLG

SEQ ID NO: 160 - protein, 121 aa, Artificial Sequence
  Description of Artificial Sequence: Synthetic polypeptide
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARSGAYWDYSVYDEWGQGTLVTVSS

SEQ ID NO: 161 - DNA, 324 bp, Artificial Sequence
  Description of Artificial Sequence: Synthetic polynucleotide
cagtctgtgttgactcagccaccctcagtgtccgtgtccccaggacagacagccaccatcgcctgttctggacataaattgggggataaatatgcttcctggtatcagcagaagtcgggccagtcccctgtgttgatcatctatcaggataataagcggccctcagggattcctgagcgattctctggctccaactctgggaacacagccactctgaccatcagcgggacccaggctctggatgaggctgactattattgtcaggcgtgggacagtagtacttatgtggcattcggcggagggaccaagctgaccgtcctaggt

SEQ ID NO: 162 - DNA, 357 bp, Artificial Sequence
  Description of Artificial Sequence: Synthetic polynucleotide
caggtgcagctgcaggagtccggcccaggactggtgaagccttcggagaccctgtccctcacctgcgttgtctctggtggctccatcagcagtagtaactggtggagctgggtccgccagcccccagggaaggggctggagtggattggggaaatctatcatagtgggagccccaactacaacccatccctcaagagtcgagtcaccatatcagtagacaagtccaagaaccagttctccctgaagctgagctctgtgaccgccgcggacacggccgtgtattactgtgcgcgcatgactactcatactttcggttacgatgcttggggtcaaggtactctggtgaccgtctcctca

SEQ ID NO: 163 - protein, 108 aa, Artificial Sequence
  Description of Artificial Sequence: Synthetic polypeptide
QSVLTQPPSVSVSPGQTATIACSGHKLGDKYASWYQQKSGQSPVLIIYQDNKRPSGIPERFSGSNSGNTATLTISGTQALDEADYYCQAWDSSTYVAFGGGTKLTVLG

SEQ ID NO: 164 - protein, 119 aa, Artificial Sequence
  Description of Artificial Sequence: Synthetic polypeptide
QVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARMTTHTFGYDAWGQGTLVTVSS

SEQ ID NO: 165 - DNA, 327 bp, Artificial Sequence
  Description of Artificial Sequence: Synthetic polynucleotide
cagcctgtgctgactcagccaccctcagtgtcagtggccccaggaaagacggccacgattacttgtgggggaaacaacattggaagtgaaagtgtgcactggtaccaccagaagccaggccaggcccctgtgttggtcatctatgatgatgccggccggccctcagggatccctgagcgattcactggctccaactctgggaacacggccaccctgaccatcagcagggtcgaagccggggatgaggccgactattactgtcaggtgtgggacagaaatagtgctcagtttgtcttcggacctgggaccaaggtcaccgtcctaggt

SEQ ID NO: 166 - DNA, 345 bp, Artificial Sequence
  Description of Artificial Sequence: Synthetic polynucleotide
gaggtccagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgcggtgttcatctggattggtggggtcaaggtactctggtgaccgtctcctca

SEQ ID NO: 167 - protein, 109 aa, Artificial Sequence
  Description of Artificial Sequence: Synthetic polypeptide
QPVLTQPPSVSVAPGKTATITCGGNNIGSESVHWYHQKPGQAPVLVIYDDAGRPSGIPERFTGSNSGNTATLTISRVEAGDEADYYCQVWDRNSAQFVFGPGTKVTVLG

SEQ ID NO: 168 - protein, 115 aa, Artificial Sequence
  Description of Artificial Sequence: Synthetic polypeptide
EVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGVHLDWWGQGTLVTVSS

SEQ ID NO: 169 - DNA, 333 bp, Artificial Sequence
  Description of Artificial Sequence: Synthetic polynucleotide
cagtctgtcgtgacgcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggttatgtcttcggaactgggaccaagctgaccgtcctaggt

SEQ ID NO: 170 - DNA, 375 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgcctgtacgaaggtggttaccatggttggggttcttggctgtcttctgattcttggggtcaaggtactctggtgaccgtctcctca

SEQ ID NO: 171 - protein, 111 aa, Artificial Sequence
  Description of Artificial Sequence: Synthetic polypeptide
QSVVTQPPSASGTPGQRVTISCSGSSSNIGSNYVYWYQQLPGTAPKLLIYSNNQRPSGVPDRFSGSKSGTSASLAISGLRSEDEADYYCAAWDDSLSGYVFGTGTKLTVLG

SEQ ID NO: 172 - protein, 125 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLYEGGYHGWGSWLSSDSWGQGTLVTVSS

SEQ ID NO: 173 - DNA, 336 bp, Artificial Sequence
  Description of Artificial Sequence: Synthetic polynucleotide
cagtctgtgttgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttattgggtgttcggcggagggaccaagctgaccgtcctaggt

SEQ ID NO: 174 - DNA, 351 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgcgcgaaggggcatttgatgcttttgatatctggggccaagggacaatggtcaccgtctcttca

SEQ ID NO: 175 - protein, 112 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYWVFGGGTKLTVLG

SEQ ID NO: 176 - protein, 116 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGAFDAFDIWGQGTMVTVS

SEQ ID NO: 177 - DNA, 333 bp, Artificial Sequence
  Description of Artificial Sequence: Synthetic polynucleotide
tcctatgagctgactcagccaccctcagcgtctgggacccccgggcagagggtcaccatctcttgttctggaagcagctccaacatcggaagtaattatgtatactggtaccagcagctcccaggaacggcccccaaactcttcatctataggaataatcagcggccctcaggggtccctgaccgattctctggctccaagtctggcacctcagcctccctggccatcagtgggctccggtccgaggatgaggctgattattactgtgcagcatgggatgacagcctgagtggttatctcttcggaactgggaccaaggtcaccgtcctaggt

SEQ ID NO: 178 - DNA, 360 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaatggcgactccaactactactacggtatggacgtctggggccaagggaccacggtcaccgtctcctca

SEQ ID NO: 179 - protein, 111 aa, Artificial Sequence
  Description of Artificial Sequence: Synthetic polypeptide
SYELTQPPSASGTPGQRVTISCSGSSSNIGSNYVYWYQQLPGTAPKLFIYRNNQRPSGVPDRFSGSKSGTSASLAISGLRSEDEADYYCAAWDDSLSGYLFGTGTKVTVLG

SEQ ID NO: 180 - protein, 120 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCANGDSNYYYGMDVWGQGTTVTVSS

SEQ ID NO: 181 - DNA, 336 bp, Artificial Sequence
  Description of Artificial Sequence: Synthetic polynucleotide
cagtctgccctgactcagcctgcctccgtgtccgggtctcctggacagtcgatcaccatctcctgcactggaaccagcagtgacattggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcatctcatatacacgcacctggaacccctatgtcttcgggagtgggaccaaggtcaccgtcctaggt

SEQ ID NO: 182 - DNA, 369 bp, Artificial Sequence
  Description of Artificial Sequence: Synthetic polynucleotide
gaggtgcagctggtgcagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaagatcgggcagcagctggctactactactacggtatggacgtctggggccaagggaccacggtcaccgtctcctca

SEQ ID NO: 183 - protein, 112 aa, Artificial Sequence
  Description of Artificial Sequence: Synthetic polypeptide
QSALTQPASVSGSPGQSITISCTGTSSDIGGYNYVSWYQQHPGKAPKLMIYDVSNRPSGVSNRFSGSKSGNTASLTISGLQAEDEADYYCISYTRTWNPYVFGSGTKVTVLG

SEQ ID NO: 184 - protein, 123 aa, Artificial Sequence
  Description of Artificial Sequence: Synthetic polypeptide
EVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDRAAAGYYYYGMDVWGQGTTVTVSS

SEQ ID NO: 185 - DNA, 318 bp, Artificial Sequence
  Description of Artificial Sequence: Synthetic polynucleotide
ctgcctgtgctgactcagccaccctcagtgtccgtgtccccaggacagacagccatcatcacctgctctggagataaattgggggaaaaatatgtttcctggtatcagcagaagccaggccagtcccctgtactggtcatcgatcaagataccaggaggccctcagggatccctgagcgattctctggctccaactctgggaccacagccactctgaccatcagcgggacccaggctatggatgaggctgactattactgtcaggcgtgggacaggggtgtggtattcggcggagggaccaagctgaccgtcctaggt

SEQ ID NO: 186 - DNA, 369 bp, Artificial Sequence
  Description of Artificial Sequence: Synthetic polynucleotide
gaggtgcagctggtggagtctgggggagacttggtacagcctggcaggtccctgagactctcctgtgcagcctctggattcacctttaatgattatgccatgcactgggtccggcaagctccagggaagggcctggagtgggtctcaggtattagttggagtggtaataacataggctatgcggactctgtgaagggccgattcaccatctccagagacaacgccaagaactccctgtatctgcaaatgaacagtctgagagctgaggacacggccttgtattactgtgcaaaagatagtatacggtatggcatcacctggggaggttttgactactggggccagggaaccctggtcaccgtctcctca

SEQ ID NO: 187 - protein, 106 aa, Artificial Sequence
  Description of Artificial Sequence: Synthetic polypeptide
LPVLTQPPSVSVSPGQTAIITCSGDKLGEKYVSWYQQKPGQSPVLVIDQDTRRPSGIPERFSGSNSGTTATLTISGTQAMDEADYYCQAWDRGVVFGGGTKLTVLG

SEQ ID NO: 188 - protein, 123 aa, Artificial Sequence
  Description of Artificial Sequence: Synthetic polypeptide
EVQLVESGGDLVQPGRSLRLSCAASGFTFNDYAMHWVRQAPGKGLEWVSGISWSGNNIGYADSVKGRFTISRDNAKNSLYLQMNSLRAEDTALYYCAKDSIRYGITWGGFDYWGQGTLVTVSS

SEQ ID NO: 189 - DNA, 333 bp, Artificial Sequence
  Description of Artificial Sequence: Synthetic polynucleotide
cagcctgtgctgactcagccaccctcggtgtccaagggcttgagacagaccgccacactcacctgcactgggaacagcaacaatgttggcaacctaggagtagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagtagcctcagtgcttgggtgttcggcggagggaccaagctgaccgtcctaggt

SEQ ID NO: 190 - DNA, 354 bp, Artificial Sequence
  Description of Artificial Sequence: Synthetic polynucleotide
gaggtgcagctggtggagtctgggggagtcgtggtacagcctggggggtccctgagactctcctgtgcagcctctggattcacctttgatgattatgccatgcactgggtccgtcaagctccggggaagggtctggagtgggtctctcttattaattgggatggtggtagcacctactatgcagactctgtgaagggtcgattcaccatctccagagacaacagcaaaaactccctgtatctgcaaatgaacagtctgagagctgaggacaccgccttgtattactgtgcaaaagggatgggcctgagggcgtttgactactggggccagggaaccctggtcaccgtctcctca

SEQ ID NO: 191 - protein, 111 aa, Artificial Sequence
  Description of Artificial Sequence: Synthetic polypeptide
QPVLTQPPSVSKGLRQTATLTCTGNSNNVGNLGVAWLQQHQGHPPKLLSYRNNNRPSGISERLSASRSGNTASLTITGLQPEDEADYYCSAWDSSLSAWVFGGGTKLTVLG

SEQ ID NO: 192 - protein, 118 aa, Artificial Sequence
  Description of Artificial Sequence: Synthetic polypeptide
EVQLVESGGVVVQPGGSLRLSCAASGFTFDDYAMHWVRQAPGKGLEWVSLINWDGGSTYYADSVKGRFTISRDNSKNSLYLQMNSLRAEDTALYYCAKGMGLRAFDYWGQGTLVTVSS

SEQ ID NO: 193 - DNA, 336 bp, Artificial Sequence
  Description of Artificial Sequence: Synthetic polynucleotide
cagtctgtgttgactcagccaccctcagcgtctgggacccccgggcagagggtcaccatctcctgttctggaagcagctccaacatcggaagtaatactgtaaactggtaccagcagctcccaggaacggcccccaaactcctcatctatagtaatgatcagcggccctcaggggtccctgaccgattctctggctccaagtccggcacctcagcctccctggccatcagtgggctccagtctgaggatgaggctgattattactgtgcttcatgggatgacagcctgaatggccgttatgtcttcggaactgggaccaaggtcaccgtcctaggt

SEQ ID NO: 194 - DNA, 366 bp, Artificial Sequence
  Description of Artificial Sequence: Synthetic polynucleotide
caggtccagctggtacagtctggggctgaggtgaggaagcctggggcctcagtgaaggtttcctgcaagacttctggatacaccttcagttggtatgctatacattgggtgcgccaggcccccggacaaaggcttgagtggatgggatggatcaacgctggcaatggaaacacaaaatattcacagaaatttcagggcagagtcagtcttaccagggacacatccgcgagcacagcctacatggagctgagcagcctgagatctgatgacacggctgtgtattactgtgcgagacccgataattatggttcgggtggggatgtttttgatatctggggccaagggacaatggtcaccgtctcttca

SEQ ID NO: 195 - protein, 112 aa, Artificial Sequence
  Description of Artificial Sequence: Synthetic polypeptide
QSVLTQPPSASGTPGQRVTISCSGSSSNIGSNTVNWYQQLPGTAPKLLIYSNDQRPSGVPDRFSGSKSGTSASLAISGLQSEDEADYYCASWDDSLNGRYVFGTGTKVTVLG

SEQ ID NO: 196 - protein, 122 aa, Artificial Sequence
  Description of Artificial Sequence: Synthetic polypeptide
QVQLVQSGAEVRKPGASVKVSCKTSGYTFSWYAIHWVRQAPGQRLEWMGWINAGNGNTKYSQKFQGRVSLTRDTSASTAYMELSSLRSDDTAVYYCARPDNYGSGGDVFDIWGQGTMVTVSS

SEQ ID NO: 197 - DNA, 333 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactttgtgcagtggtaccagcagcgcccgggcagtgcccccacccctatgatctatgaggataacaacagaccccctggggtccctgatcggttctctgcctccgtcgacagctcctccaactctgcctccctcaccatctctggactgaagactgaggacgaggctgactactactgtcagtcttatgataccagcaatgtggtattcggcggggggaccaagctgaccgtcctaggt

SEQ ID NO: 198 - DNA, 348 bp, Artificial Sequence
  Description of Artificial Sequence: Synthetic polynucleotide
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcacgctgggactacggtatggacgtctggggccaagggaccacggtcaccgtctcctca

SEQ ID NO: 199 - protein, 111 aa, Artificial Sequence
  Description of Artificial Sequence: Synthetic polypeptide
NFMLTQPHSVSESPGKTVTISCTRSSGSIASNFVQWYQQRPGSAPTPMIYEDNNRPPGVPDRFSASVDSSSNSASLTISGLKTEDEADYYCQSYDTSNVVFGGGTKLTVLG

SEQ ID NO: 200 - protein, 116 aa, Artificial Sequence
  Description of Artificial Sequence: Synthetic polypeptide
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSS

SEQ ID NO: 201 - DNA, 333 bp, Artificial Sequence
  Description of Artificial Sequence: Synthetic polynucleotide
caggctgtgctgactcagccaccctcagcgtctggggcccccgggcagagggtcaccgtctcttgttctggaagcaactccaacatcggaagtaactacgttaactggtaccagcagttcccaggaacggcccccaaactcctcatgtatagtagtagtcagcggccctcaggggtccctgaccgattctctggctccaagtctggcacctcagcctccctggccatcagtgggctccactctgaggatgaggctgattattactgtgctacatgggatgacagcctgaatgcttgggtgttcggcggagggaccaagctgaccgtcctaggt

SEQ ID NO: 202 - DNA, 366 bp, Artificial Sequence
  Description of Artificial Sequence: Synthetic polynucleotide
gaggtccagctggtgcagtctggggctgaggtgaggaagcctggggcctcagtgaaggtttcctgcaagacttctggatacaccttcacttggtatgctatacattgggtgcgccaggcccccggacaaaggcttgagtggatgggatggatcaacgctggcagtggaaacacaaaatattcacagaaatttcagggcagagtcacccttaccagggacacatccgcgagcacagcgtacatggagctgagcagcctgagatctgatgacacggctgtgtattactgtgcgagacccaataactatggttcgggtggggatgtttttgatatctggggccaagggacaatggtcaccgtctcttca

SEQ ID NO: 203 - protein, 111 aa, Artificial Sequence
  Description of Artificial Sequence: Synthetic polypeptide
QAVLTQPPSASGAPGQRVTVSCSGSNSNIGSNYVNWYQQFPGTAPKLLMYSSSQRPSGVPDRFSGSKSGTSASLAISGLHSEDEADYYCATWDDSLNAWVFGGGTKLTVLG

SEQ ID NO: 204 - protein, 122 aa, Artificial Sequence
  Description of Artificial Sequence: Synthetic polypeptide
EVQLVQSGAEVRKPGASVKVSCKTSGYTFTWYAIHWVRQAPGQRLEWMGWINAGSGNTKYSQKFQGRVTLTRDTSASTAYMELSSLRSDDTAVYYCARPNNYGSGGDVFDIWGQGTMVTVSS

SEQ ID NO: 205 - DNA, 333 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgcttatgtcttcggaactgggaccaaggtcaccgtcctaggt

SEQ ID NO: 206 - DNA, 363 bp, Artificial Sequence
  Description of Artificial Sequence: Synthetic polynucleotide
caggtccagctggtgcagtctggggctgaggtgaagaagcctggggcctcagtgaaagtttcctgcaaggcttctggatacaccttcacgaactatgctctgcattgggtgcgccaggcccccggacaagggcttgagtggatggcatggatcaacggtggcaatggtaacacaaaatattcacagaacttccagggcagagtcaccattaccagggacacatccgcgagcacagcctatatggagctgagcagcctgagatctgaagacacggctgtgtattactgtgcgaaaccggaggaaacagctggaacaatccactttgactactggggccagggaaccccggtcaccgtctcctca

SEQ ID NO: 207 - protein, 111 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLG

SEQ ID NO: 208 - protein, 121 aa, Artificial Sequence
  Description of Artificial Sequence: Synthetic polypeptide
QVQLVQSGAEVKKPGASVKVSCKASGYTFTNYALHWVRQAPGQGLEWMAWINGGNGNTKYSQNFQGRVTITRDTSASTAYMELSSLRSEDTAVYYCAKPEETAGTIHFDYWGQGTPVTVSS

SEQ ID NO: 209 - DNA, 333 bp, Artificial Sequence
  Description of Artificial Sequence: Synthetic polynucleotide
caggctgtgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaccatcacggtgttcggcggagggaccaagctgaccgtcctaggt

SEQ ID NO: 210 - DNA, 378 bp, Artificial Sequence
  Description of Artificial Sequence: Synthetic polynucleotide
caggtccagctggtacagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgggggagggttactatgatagtagtggttattccaacggtgatgcttttgatatctggggccaagggacaatggtcaccgtctcttca

SEQ ID NO: 211 - protein, 111 aa, Artificial Sequence
  Description of Artificial Sequence: Synthetic polypeptide
QAVLTQPHSVSESPGKTVTISCTRSSGSIASNYVQWYQQRPGSAPTTVIYEDNQRPSGVPDRFSGSIDSSSNSASLTISGLKTEDEADYYCQSYDSTITVFGGGTKLTVLG

SEQ ID NO: 212 - protein, 126 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCAGEGYYDSSGYSNGDAFDIWGQGTMVTVSS

SEQ ID NO: 213 - DNA, 333 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatgtggtattcggcggagggaccaaggtcaccgtcctaggt

SEQ ID NO: 214 - DNA, 348 bp, Artificial Sequence; identical to SEQ ID NO: 198
  Description of Artificial Sequence: Synthetic polynucleotide

SEQ ID NO: 215 - protein, 111 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNVVFGGGTKVTVLG

SEQ ID NO: 216 - protein, 116 aa, Artificial Sequence; identical to SEQ ID NO: 200
  Description of Artificial Sequence: Synthetic polypeptide

SEQ ID NO: 217 - DNA, 321 bp, Artificial Sequence
  Description of Artificial Sequence: Synthetic polynucleotide
tcctatgtgctgactcagccaccctcagtgtccgtgtccccaggacagacagccagcatcacctgctctggagatagattgacgaataaatatgtttcctggtatcaacagaagccaggccagtcccctgtgttggtcatctatgaggatgccaagcggccctcagggatccctgcgcgattctctggctccaactctgggaacacagccactctgaccatcagcgggacccaggctatggatgagtctgaatattactgtcaggcgtgggacagcagtgtggtggtttttggcggagggaccaagctgaccgtcctaggt

SEQ ID NO: 218 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggatttacctttgatgattatgccatgcactgggtccggcaagctccagggaagggcctggagtgggtctcaggtattagttggaatagtggtagtataggctatgcggactctgtgaagggccgattcaccatctccagagacaacgccaagaactccctgtatctgcaaatgaacagtctgagagatgaggacacggccttgtattactgtgcaaaagaccgaggggggggagttatcgttaaggatgcttttgatatctggggccaagggacaatggtcaccgtctcttca

SEQ ID NO: 219 - protein, 107 aa, Artificial Sequence
  Description of Artificial Sequence: Synthetic polypeptide
SYVLTQPPSVSVSPGQTASITCSGDRLTNKYVSWYQQKPGQSPVLVIYEDAKRPSGIPARFSGSNSGNTATLTISGTQAMDESEYYCQAWDSSVVVFGGGTKLTVLG

SEQ ID NO: 220 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRDEDTALYYCAKDRGGGVIVKDAFDIWGQGTMVTVSS

SEQ ID NO: 221 - DNA, 333 bp, Artificial Sequence
  Description of Artificial Sequence: Synthetic polynucleotide
tcctatgagctgactcagccacccgcagcgtctgggacccccggacagagagtcaccatctcttgttctgggggcgtctccaacatcgggagtggtgctctaaattggtaccagcaactcccaggaacggcccccaaactcctcatctatagttacaatcagcggccctcaggggtctctgaccgattctctggctccaggtctgccacctcagcctccctggccatcagtgggctccagtctgaggatgaggctgattattactgtgcaacctgggatgatagtgtgaatggttgggtgttcggcggagggaccaagctgaccgtcctaggt

SEQ ID NO: 222 - DNA, 354 bp, Artificial Sequence
  Description of Artificial Sequence: Synthetic polynucleotide
gaggtgcagctggtggagtctggagctgaggtgaagaagcctggggattcagtgaaggtctcctgcaagccttctggttacaattttctcaactatggtatcaactgggtgcgacaggcccctggacaagggcttgagtggatgggatggattagcacttacaccggtaacacaaactatgcacagaagctgcagggcagagtcaccttcaccacagacacatccacgagcacagcctacatggagatgaggagcctgagatctgacgacacggccgtgtattactgtgcgcgccagcagggtggtggttggtacgatgtttggggtcaaggtactctggtcaccgtctcctca

SEQ ID NO: 223 - protein, 111 aa, Artificial Sequence
  Description of Artificial Sequence: Synthetic polypeptide
SYELTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLG

SEQ ID NO: 224 - protein, 118 aa, Artificial Sequence
  Description of Artificial Sequence: Synthetic polypeptide
EVQLVESGAEVKKPGDSVKVSCKPSGYNFLNYGINWVRQAPGQGLEWMGWISTYTGNTNYAQKLQGRVTFTTDTSTSTAYMEMRSLRSDDTAVYYCARQQGGGWYDVWGQGTLVTVSS

SEQ ID NO: 225 - DNA, 336 bp, Artificial Sequence
  Description of Artificial Sequence: Synthetic polynucleotide
cagtctgtcgtgacgcagccgccctcagtgtctgcggccccaggagagaaggtcaccatctcctgctctggaagcaacttcaatgttggaaataatgatgtatcctggtatcagcaactcccaggtgcagcccccaaactcctcatttatgacaataataagcgaccctcagggattcctgaccgattctctggctccaagtctggcacgtcagccaccctggacatcaccgggctccacagtgacgacgaggccgattattactgcggaacatgggatagcagcctgaatactgggggggtcttcggaactgggaccaaggtcaccgtcctaggt

SEQ ID NO: 226 - DNA, 369 bp, Artificial Sequence
  Description of Artificial Sequence: Synthetic polynucleotide
gaggtccagctggtgcagtctggagctgaggtgaagaagcctggggcctcagtgaaggtctcctgcaaggcttctggttacacctttaccagctatactatcagctgggtacgacaggcccctggacaagggcttgagtggatgggatggatcagcacttacaatggtctcacaaactatgcacagaacctccagggcagagtcaccatgactacagacacattcacgaccacagcctacatggagctgaggagcctcagatctgacgacacggccgtgtattactgtgtgagagaggggtcccccgactacggtgacttcgcgtcctttgactactggggccagggaaccctggtcaccgtctcctca

SEQ ID NO: 227 - protein, 112 aa, Artificial Sequence
  Description of Artificial Sequence: Synthetic polypeptide
QSVVTQPPSVSAAPGEKVTISCSGSNFNVGNNDVSWYQQLPGAAPKLLIYDNNKRPSGIPDRFSGSKSGTSATLDITGLHSDDEADYYCGTWDSSLNTGGVFGTGTKVTVLG

SEQ ID NO: 228 - protein, 123 aa, Artificial Sequence
  Description of Artificial Sequence: Synthetic polypeptide
EVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSS

SEQ ID NO: 229 - DNA, 336 bp, Artificial Sequence
  Description of Artificial Sequence: Synthetic polynucleotide
cagtctgtgttgacgcagccgccctcagtgtctgcgcccccgggacagaaggtcaccatctcctgctctggaagcagctccaacattgggaataattatgtatcctggtaccagcagttcccaggaacagcccccaaactcctcatttatgacaataataagcgaccctcagggatttctgaccgattctctggctccaagtctggcacgtcagccaccctgggcatcgccggactccagactggggacgaggccgattattactgcggaacatgggataccagcctgagtggtttttatgtcttcggaagtgggaccaaggtcaccgtcctaggt

SEQ ID NO: 230 - DNA, 369 bp, Artificial Sequence
  Description of Artificial Sequence: Synthetic polynucleotide
gaggtccagctggtacagtctggagctgaggtgaagaagcctggggcctcagtgaaggtctcctgcaaggcttctggttacacctttaccagctatactatcagctgggtacgacaggcccctggacaagggcttgagtggatgggatggatcagcacttacaatggtctcacaaactatgcacagaacctccagggcagagtcaccatgactacagacacattcacgaccacagcctacatggagctgaggagcctcagatctgacgacacggccgtgtattactgtgtgagagaggggtcccccgactacggtgacttcgcgtcctttgactactggggccagggaaccctggtcaccgtctcctca

SEQ ID NO: 231 - protein, 112 aa, Artificial Sequence
  Description of Artificial Sequence: Synthetic polypeptide
QSVLTQPPSVSAPPGQKVTISCSGSSSNIGNNYVSWYQQFPGTAPKLLIYDNNKRPSGISDRFSGSKSGTSATLGIAGLQTGDEADYYCGTWDTSLSGFYVFGSGTKVTVLG

SEQ ID NO: 232 - protein, 123 aa, Artificial Sequence; identical to SEQ ID NO: 228
  Description of Artificial Sequence: Synthetic polypeptide

SEQ ID NO: 233 - DNA, 333 bp, Artificial Sequence
  Description of Artificial Sequence: Synthetic polynucleotide
ctgcctgtgctgactcagccaccctcagcgtctgcgacccccgggcagagggtcaccatctcttgttctggaaccacctccaacatcggaagtaatactgtacactggtaccagcagctcccagggacggcccccaaactcctcatctataataataatcagcggccctcaggggtccctgaccgattctctggctccaagtctggcacctcagcctccctggccatcagtgggctccggtccgaggatgaggctacatattcctgtgcaacatgggatgacagcctgagtggtgtggtcttcggcggagggaccaagctgaccgtcctaggt

SEQ ID NO: 234 - DNA, 369 bp, Artificial Sequence
  Description of Artificial Sequence: Synthetic polynucleotide
gaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagatcccgcctacggtgactacgagtatgatgcttttgatatctggggccaagggacaatggtcaccgtctcttca

SEQ ID NO: 235 - protein, 111 aa, Artificial Sequence
  Description of Artificial Sequence: Synthetic polypeptide
LPVLTQPPSASATPGQRVTISCSGTTSNIGSNTVHWYQQLPGTAPKLLIYNNNQRPSGVPDRFSGSKSGTSASLAISGLRSEDEATYSCATWDDSLSGVVFGGGTKLTVLG

SEQ ID NO: 236 - protein, 123 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDPAYGDYEYDAFDIWGQGTMVTVSS

SEQ ID NO: 237 - DNA, 333 bp, Artificial Sequence
  Description of Artificial Sequence: Synthetic polynucleotide
cagtctgtgttgacgcagccgccctcagcgtctgggacccccgggcagagggtcaccatctcttgttctggaagcagctccaacatcggaactaatggtgtaaactggttccagcagttcccaggaacggcccccaaactcctcatctatactaatgatcagcggccctcaggggtccctgaccgattctctggctccaagtctggcacctcagcctccctggccatcagtgggctccagtctgcggatgaggctgattattactgtgcagtgtgggaccacagcctgaatggtccggtgttcggcggagggaccaagctgaccgtcctaggt

SEQ ID NO: 238 - DNA, 354 bp, Artificial Sequence
  Description of Artificial Sequence: Synthetic polynucleotide
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaggggccggttttgatgcttttgatatctggggccaagggacaatggtcaccgtctcttca

SEQ ID NO: 239 - protein, 111 aa, Artificial Sequence
  Description of Artificial Sequence: Synthetic polypeptide
QSVLTQPPSASGTPGQRVTISCSGSSSNIGTNGVNWFQQFPGTAPKLLIYTNDQRPSGVPDRFSGSKSGTSASLAISGLQSADEADYYCAVWDHSLNGPVFGGGTKLTVLG

SEQ ID NO: 240 - protein, 118 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGAGFDAFDIWGQGTMVTVSS

SEQ ID NO: 241 - DNA, 333 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgagactgattattactgtgcagcatgggatgacagcctgaatggttatgtcttcggaactgggaccaaggtcaccgtcctaggt

SEQ ID NO: 242 - DNA, 348 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagaggggctagatgcttttgatatctggggccaagggacaatggtcaccgtctcttca

SEQ ID NO: 243 - protein, 111 aa, Artificial Sequence
  Description of Artificial Sequence: Synthetic polypeptide
QAVLTQPPSASGTPGQRVTISCSGSSSNIGSNTVNWYQQLPGTAPKLLIYSNNQRPSGVPDRFSGSKSGTSASLAISGLQSEDETDYYCAAWDDSLNGYVFGTGTKVTVLG

SEQ ID NO: 244 - protein, 116 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSS

SEQ ID NO: 245 - DNA, 333 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatgtatagtaatgatcagcggccctcaggggtccctgaccgattctctggctccaagtctggcacctcagcctccctggccatcagtgggctccagtctgaggatgaggctgattattattgtgcagcatgggatgacagcctgaatggttatgtcttcgcagctgggacccagctcaccgttttaagt

SEQ ID NO: 246 - DNA, 348 bp, Artificial Sequence; identical to SEQ ID NO: 242
  Description of Artificial Sequence: Synthetic polynucleotide

SEQ ID NO: 247 - protein, 111 aa, Artificial Sequence
  Description of Artificial Sequence: Synthetic polypeptide
QAVLTQPPSASGTPGQRVTISCSGSSSNIGSNTVNWYQQLPGTAPKLLMYSNDQRPSGVPDRFSGSKSGTSASLAISGLQSEDEADYYCAAWDDSLNGYVFAAGTQLTVLS

SEQ ID NO: 248 - protein, 116 aa, Artificial Sequence; identical to SEQ ID NO: 244
  Description of Artificial Sequence: Synthetic polypeptide

SEQ ID NO: 249 - DNA, 336 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcactggactccagactggggacgaggccgattattactgcggaacatgggatagcagcctgagtgctgcttatgtcttcggaactgggaccaaggtcaccgtcctaggt

SEQ ID NO: 250 - DNA, 369 bp, Artificial Sequence
  Description of Artificial Sequence: Synthetic polynucleotide
caggtccagctggtacagtctggagctgaggtgaagaagcctggggcctcagtgaaggtctcctgcaaggcttctggttacagctttaccagctatactatcagctgggttcgacaggcccctggacaaggccttgagtggatgggatgggtcagcacttacaatggtctcagaaactatgcacagaacctccagggcagagtcaccatgactacagacacactcacgaccacagcctacatggagctgaggagcctcagatctgacgacacggccgtgtattattgtgtgagagaggggtcccccgactacggtgacttcgcggcctttgactactggggccagggcaccctggtcaccgtctcctca

SEQ ID NO: 251 - protein, 112 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAAYVFGTGTKVTVLG

SEQ ID NO: 252 - protein, 123 aa, Artificial Sequence
  Description of Artificial Sequence: Synthetic polypeptide
QVQLVQSGAEVKKPGASVKVSCKASGYSFTSYTISWVRQAPGQGLEWMGWVSTYNGLRNYAQNLQGRVTMTTDTLTTTAYMELRSLRSDDTAVYYCVREGSPDYGDFAAFDYWGQGTLVTVSS

SEQ ID NO: 253 - DNA, 330 bp, Artificial Sequence
  Description of Artificial Sequence: Synthetic polynucleotide
caggctgtgctgactcagccaccctcagcgtctgagacccccgggcagagggtcaccatctcttgttctggaagcaggtccaacatcggaactaatattgtacactggtaccagcagcgcccaggaatggcccccaaactcctcacttatggtagtcggcggccctcaggggtcccggaccgattctctggctccaagtttggcacctcagcctccctggccatcagtgggctccagtctgaggatgaggctgattattattgtgcagcatgggatgacagtctgaatggtccggctttcggcggagggaccaagctgaccgtcctaggt

SEQ ID NO: 254 - DNA, 348 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagacggtgggggctactttgactactggggccagggaaccctggtcaccgtctcctca

SEQ ID NO: 255 - protein, 110 aa, Artificial Sequence
  Description of Artificial Sequence: Synthetic polypeptide
QAVLTQPPSASETPGQRVTISCSGSRSNIGTNIVHWYQQRPGMAPKLLTYGSRRPSGVPDRFSGSKFGTSASLAISGLQSEDEADYYCAAWDDSLNGPAFGGGTKLTVLG

SEQ ID NO: 256 - protein, 116 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDGGGYFDYWGQGTLVTVSS

SEQ ID NO: 257 - DNA, 336 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaatatcggggcacgttatgatgtacactggtaccagcaactcccaggaacagccccccgactcctcatctctgctaactacgatcggccctcaggggtccctgaccgattctctggctccaagtctggcacctcagcctccctggccatcactgggctccaggctgaggatgaggctgattattactgccagtcctatgacagcagtgtgagtgcttgggtgttcggcggagggaccaaggtcaccgtcctaggt

SEQ ID NO: 258 - DNA, 363 bp, Artificial Sequence
  Description of Artificial Sequence: Synthetic polynucleotide
gaagtgcagctggtgcagtctggggctgaagtgaaggagcctggggcctcagtgaggatctcctgccaggcatctggatacaacttcatcagttattatatgcactgggtgcggcaggcccctgggcaaggtcttgagtggatgggcaccatcaacccaggcagtggtgagacagactactcacagaagttgcagggcagagtcaccatgaccagggacccgtccacgggtacattcgacatggggctgagcagcctgacatctggggacacggccgtctattattgtgcgacaggtctcatcagaggagctagcgatgcttttaatatctggggccgggggacaatggtcaccgtctcttca

SEQ ID NO: 259 - protein, 112 aa, Artificial Sequence
  Description of Artificial Sequence: Synthetic polypeptide
QSVLTQPPSVSGAPGQRVTISCTGSSSNIGARYDVHWYQQLPGTAPRLLISANYDRPSGVPDRFSGSKSGTSASLAITGLQAEDEADYYCQSYDSSVSAWVFGGGTKVTVLG

SEQ ID NO: 260 - protein, 121 aa, Artificial Sequence
  Description of Artificial Sequence: Synthetic polypeptide
EVQLVQSGAEVKEPGASVRISCQASGYNFISYYMHWVRQAPGQGLEWMGTINPGSGETDYSQKLQGRVTMTRDPSTGTFDMGLSSLTSGDTAVYYCATGLIRGASDAFNIWGRGTMVTVSS

SEQ ID NO: 261 - DNA, 321 bp, Artificial Sequence
  Description of Artificial Sequence: Synthetic polynucleotide
cagcctgtgctgactcagccaccctcagtgtccgtgtccccaggacagacggccgccatcccctgttctggagataagttgggggataaatttgcttcctggtatcagcagaagccaggccagtcccctgtgctggtcatctatcaagatactaagcggccctcagggatccctgagcgattctctggctccaactctgggaacacagccactctgaccatcagcgggacccaggctatggatgaggctgactattactgtcagacgtgggccagcggcattgtggtgttcggcggagggaccaagctgaccgtcctaggt

SEQ ID NO: 262 - DNA, 366 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagcgcagtggctggaagggatttgactactggggccagggaaccctggtcaccgtctcctca

SEQ ID NO: 263 - protein, 107 aa, Artificial Sequence
  Description of Artificial Sequence: Synthetic polypeptide
QPVLTQPPSVSVSPGQTAAIPCSGDKLGDKFASWYQQKPGQSPVLVIYQDTKRPSGIPERFSGSNSGNTATLTISGTQAMDEADYYCQTWASGIVVFGGGTKLTVLG

SEQ ID NO: 264 - protein, 122 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARERSGWKGFDYWGQGTLVTVSS

SEQ ID NO: 265 - DNA, 339 bp, Artificial Sequence
  Description of Artificial Sequence: Synthetic polynucleotide
gatgttgtgatgactcagtctccaccctccctgtccgtcacccctggagagccggcctccatcacctgcaggtctagtcagagcctcctggaaagaaatgcatacaactacttggattggtacctgcagaggccaggacagtctccacagctcctgatctacttgggttctaatcgggccgccggggtccctgacaggttcagtggcagtggatcaggcagagattttacactgaaaatcagcagagtggagcctgaggatgttggggtttattactgcatgcaagctctacaagctccgttcactttcggcggagggaccaaggtggagatcaaacgt

SEQ ID NO: 266 - DNA, 357 bp, Artificial Sequence
  Description of Artificial Sequence: Synthetic polynucleotide
gaagtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaatggggcccgtttcaggatgcttttgatatctggggccaagggacaatggtcaccgtctcttca

SEQ ID NO: 267 - protein, 113 aa, Artificial Sequence
  Description of Artificial Sequence: Synthetic polypeptide
DVVMTQSPPSLSVTPGEPASITCRSSQSLLERNAYNYLDWYLQRPGQSPQLLIYLGSNRAAGVPDRFSGSGSGRDFTLKISRVEPEDVGVYYCMQALQAPFTFGGGTKVEIKR

SEQ ID NO: 268 - protein, 119 aa, Artificial Sequence
  Description of Artificial Sequence: Synthetic polypeptide
EVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKWGPFQDAFDIWGQGTMVTVSS

SEQ ID NO: 269 - DNA, 336 bp, Artificial Sequence
  Description of Artificial Sequence: Synthetic polynucleotide
caggctgtgctgactcagcctgcctccgtgtctgggtctcctggacagtcgatcaccatctcctgcactggaaccagcagtgacgttggtggttataactatgtctcctggtaccaacagcacccgggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcaccccttatgtcttcggagcagggaccaaggtcaccgtcctaggt

SEQ ID NO: 270 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagccaggtggacagcagtggcatcagaccaccactttgactactggggccagggaacgctggtcaccgtctcctca

SEQ ID NO: 271 - protein, 112 aa, Artificial Sequence
  Description of Artificial Sequence: Synthetic polypeptide
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTPYVFGAGTKVTVLG

SEQ ID NO: 272 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKARWTAVASDHHFDYWGQGTLVTVSS

SEQ ID NO: 273 - DNA, 333 bp, Artificial Sequence
  Description of Artificial Sequence: Synthetic polynucleotide
caggctgtgcttactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaagctgaccgtcctaggt

SEQ ID NO: 274 - DNA, 348 bp, Artificial Sequence
  Description of Artificial Sequence: Synthetic polynucleotide
gaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagattgggactacatggacgtctggggcaaagggaccacggtcaccgtctcctca

SEQ ID NO: 275 - protein, 111 aa, Artificial Sequence
  Description of Artificial Sequence: Synthetic polypeptide
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVLG

SEQ ID NO: 276 - protein, 116 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDWDYMDVWGKGTTVTVSS

SEQ ID NO: 277 - DNA, 333 bp, Artificial Sequence
  Description of Artificial Sequence: Synthetic polynucleotide
tcctatgagctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggt

SEQ ID NO: 278 - DNA, 381 bp, Artificial Sequence
  Description of Artificial Sequence: Synthetic polynucleotide
gaggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacctatctcggggagctaacccgcattactactactactacggtatggacgtctggggccaagggaccacggtcaccgtctcctca

SEQ ID NO: 279 - protein, 111 aa, Artificial Sequence
  Description of Artificial Sequence: Synthetic polypeptide
SYELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLG

SEQ ID NO: 280 - protein, 127 aa, Artificial Sequence
  Description of Artificial Sequence: Synthetic polypeptide
EVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSS

SEQ ID NO: 281 - DNA, 342 bp, Artificial Sequence
  Description of Artificial Sequence: Synthetic polynucleotide
cagtctgtgttgacgcagccgccctcagtgtctggggccccagggcagagggtcaccgtctcctgcactgggagcagatccaacatcggggcaggatatgatgtacactggtaccagcaacttccaggaacagcccccaaactcctcatctatggaaatagtaatcggcctccaggggtccctgaccgattctctgggtctaagtctggcacctcagcctccctggtcatcactgggctccaggctgaggatgccgctgattattactgccagtcctatgacaacactgtgcgtgaatcaccttatgtcttcggaactgggaccaaggtcaccgtcctaggt

SEQ ID NO: 282 - DNA, 375 bp, Artificial Sequence
  Description of Artificial Sequence: Synthetic polynucleotide
gaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagagtaatttagtgtcccggcactactactactacggtatggacgtctggggccaagggaccacggtcaccgtctcctca

SEQ ID NO: 283 - protein, 114 aa, Artificial Sequence
  Description of Artificial Sequence: Synthetic polypeptide
QSVLTQPPSVSGAPGQRVTVSCTGSRSNIGAGYDVHWYQQLPGTAPKLLIYGNSNRPPGVPDRFSGSKSGTSASLVITGLQAEDAADYYCQSYDNTVRESPYVFGTGTKVTVLG

SEQ ID NO: 284 - protein, 125 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATESNLVSRHYYYYGMDVWGQGTTVTVSS

SEQ ID NO: 285 - DNA, 333 bp, Artificial Sequence
  Description of Artificial Sequence: Synthetic polynucleotide
ctgcctgtgctgactcagccaccctcagcgtctgggacccccgggcagagggtcaccatctcttgttctggaaccagctccaacatcggaagtaattctgtagactggtaccagcagctcccaggaacggcccccaaactcctcatctatagtaataatcagcggccctcaggggtccctgaccgaatctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggt

SEQ ID NO: 286 - DNA, 396 bp, Artificial Sequence
  Description of Artificial Sequence: Synthetic polynucleotide
gaagtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagattacggatactatggttcggggagttattcgagcggccccctttactactactacggtatggacgtctggggccaagggaccacggtcaccgtctcctca

SEQ ID NO: 287 - protein, 111 aa, Artificial Sequence
  Description of Artificial Sequence: Synthetic polypeptide
LPVLTQPPSASGTPGQRVTISCSGTSSNIGSNSVDWYQQLPGTAPKLLIYSNNQRPSGVPDRISGSKSGTSASLAISGLQSEDEADYYCAAWDDSLNGYVFGTGTKVTVLG

SEQ ID NO: 288 - protein, 132 aa, Artificial Sequence
  Description of Artificial Sequence: Synthetic polypeptide
EVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGYYGSGSYSSGPLYYYYGMDVWGQGTTVTVSS

SEQ ID NO: 289 - DNA, 333 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatgtataataatgatcagcggccctcaggggtccctgaccgattctctggctccaagtctggcacctcagcctccctggccatcagtgggctccagtctgaggatgaggctgattattactgtgcagcatgggatgacagcctcaatggttatgtcttcggacctgggaccaaggtcaccgtcctaggt

SEQ ID NO: 290 - DNA, 381 bp, Artificial Sequence
  Description of Artificial Sequence: Synthetic polynucleotide
caggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacctatctcggggagctaacccgcattactactactactacggtatggacgtctggggccaagggaccacggtcaccgtctcctca

SEQ ID NO: 291 - protein, 111 aa, Artificial Sequence
  Description of Artificial Sequence: Synthetic polypeptide
QAVLTQPPSASGTPGQRVTISCSGSSSNIGSNTVNWYQQLPGTAPKLLMYNNDQRPSGVPDRFSGSKSGTSASLAISGLQSEDEADYYCAAWDDSLNGYVFGPGTKVTVLG

SEQ ID NO: 292 - protein, 127 aa, Artificial Sequence
  Description of Artificial Sequence: Synthetic polypeptide
QVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSS

SEQ ID NO: 293 - DNA, 333 bp, Artificial Sequence
  Description of Artificial Sequence: Synthetic polynucleotide
aattttatgctgactcagccccacgctgtgtcggagtctccggggaagacggtaaccatctcctgcacccgcagcagtggcagtattgccagcaactatgtgcagtggtaccagcagcgcccgggcagttccccccgcactgtgatttatgaggataatcaaagaccctctggggtccctggtcggttctctggctccatcgacagctcctccaactctgcctccctcaccatctctggactgaagactgaggacgaggctgactactactgtcagtcttatgattccaccagtgtgcttttcggcggagggaccaagctgaccgtcctaggt

SEQ ID NO: 294 - DNA, 360 bp, Artificial Sequence
  Description of Artificial Sequence: Synthetic polynucleotide
gaggtccagctggtgcagtctggggctgaggtgaagaagccagggtcctcggtgaaggtctcctgcaaggcctcgggaggcaccttcagcagcaattctctcagctgggtgcgacaggcccctggacaagggcttgagtggatgggaaggatcttccctatcctgggtataacaaactatgcacagaagttccagggcagagtcacgattaccgcggacaaatccacgagcacagcctacatggagctgagcagcctgagatctgaggacacggccgtctattactgtgcgagaggaaactaccaatggtatgatgcttttgatatctggggccaagggacaatggtcaccgtctcttca

SEQ ID NO: 295 - protein, 111 aa, Artificial Sequence
  Description of Artificial Sequence: Synthetic polypeptide
NFMLTQPHAVSESPGKTVTISCTRSSGSIASNYVQWYQQRPGSSPRTVIYEDNQRPSGVPGRFSGSIDSSSNSASLTISGLKTEDEADYYCQSYDSTSVLFGGGTKLTVLG

SEQ ID NO: 296 - protein, 120 aa, Artificial Sequence
  Description of Artificial Sequence: Synthetic polypeptide
EVQLVQSGAEVKKPGSSVKVSCKASGGTFSSNSLSWVRQAPGQGLEWMGRIFPILGITNYAQKFQGRVTITADKSTSTAYMELSSLRSEDTAVYYCARGNYQWYDAFDIWGQGTMVTVSS

SEQ ID NO: 297 - DNA, 330 bp, Artificial Sequence
  Description of Artificial Sequence: Synthetic polynucleotide
cagcctgtgctgactcagccaccctcagtgtcagtggtcccaggaaagacggccaggattacctgtgggggaaaaaacattggaagtaaaagtgtgcactggtaccagcagaagccaggccaggcccctgtggtggtcatccattatgatagtgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggt

SEQ ID NO: 298 - DNA, 351 bp, Artificial Sequence
  Description of Artificial Sequence: Synthetic polynucleotide
caggtgcagctggtgcagtctggagctgaggtgaagaagcctggggcctcagtgaaggtctcctgcaaggcttctggttacacctttaccaactatggtatcagctgggtgcgacaggcccctggacaagggcttgagtggatgggatggatcagcgcttacaatggtaacacaaactatgcacataagctccagggcagagtcaccatgaccacagacacatccacgagcacagccaacatggagctgaggagcctgagacctgacgacactgccgtgtattactgtgcgcgctcttacttcggttctcatgattactggggtcaaggtactctggtgaccgtctcctca

SEQ ID NO: 299 - protein, 110 aa, Artificial Sequence
  Description of Artificial Sequence: Synthetic polypeptide
QPVLTQPPSVSVVPGKTARITCGGKNIGSKSVHWYQQKPGQAPVVVIHYDSDRPSGIPERFSGSNSGNTATLTISRVEAGDEADYYCQVWDSSSDHPYVFGTGTKVTVLG

SEQ ID NO: 300 - protein, 117 aa, Artificial Sequence
  Description of Artificial Sequence: Synthetic polypeptide
QVQLVQSGAEVKKPGASVKVSCKASGYTFTNYGISWVRQAPGQGLEWMGWISAYNGNTNYAHKLQGRVTMTTDTSTSTANMELRSLRPDDTAVYYCARSYFGSHDYWGQGTLVTVSS

SEQ ID NO: 301 - DNA, 327 bp, Artificial Sequence
  Description of Artificial Sequence: Synthetic polynucleotide
tcctatgtgctgactcagccaccctcggtgtcagtggccccaggaaagacggccaggatttcctgtgggggaaacgacattggaagtaaaagtgttttctggtatcagcagaggccaggccaggcccctgtgttggtcgtctatgatgatagcgaccggccctcagggctccctgagcgattctctggcttcaactctgggaacacggccaccctgaccatcagcagggtcgaagccggggatgaggccgactattactgtcaagtgtgggatagtagtagtgatcattatgtcttcggaactgggaccaaggtcaccgtcctaggt

SEQ ID NO: 302 - DNA, 369 bp, Artificial Sequence
  Description of Artificial Sequence: Synthetic polynucleotide
caggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatataacctatggttcggggagttatggtgcttttgatatctggggccaagggacaatggtcaccgtctcttca

SEQ ID NO: 303 - protein, 109 aa, Artificial Sequence
  Description of Artificial Sequence: Synthetic polypeptide
SYVLTQPPSVSVAPGKTARISCGGNDIGSKSVFWYQQRPGQAPVLVVYDDSDRPSGLPERFSGFNSGNTATLTISRVEAGDEADYYCQVWDSSSDHYVFGTGTKVTVLG

SEQ ID NO: 304 - protein, 123 aa, Artificial Sequence
  Description of Artificial Sequence: Synthetic polypeptide
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDITYGSGSYGAFDIWGQGTMVTVSS

SEQ ID NO: 305 - DNA, 63 bp, Artificial Sequence
  Description of Artificial Sequence: Synthetic oligonucleotide
tctagaggtggtggtggtagcggcggcggcggctctggtggtggtggatccctcgagatggcc

SEQ ID NO: 306 - DNA, 75 bp, Artificial Sequence
  Description of Artificial Sequence: Synthetic oligonucleotide
actagtggccaggccggccagcaccatcaccatcaccatggcgcatacccgtacgacgttccggactacgcttct

SEQ ID NO: 307 - protein, 21 aa, Artificial Sequence
  Description of Artificial Sequence: Synthetic peptide
SRGGGGSGGGGSGGGGSLEMA

SEQ ID NO: 308 - protein, 25 aa, Artificial Sequence
  Description of Artificial Sequence: Synthetic peptide
TSGQAGQHHHHHHGAYPYDVPDYAS

SEQ ID NO: 309 - protein, 8 aa, Artificial Sequence
  Description of Artificial Sequence: Synthetic peptide
GGSFSGYY

SEQ ID NO: 310 - protein, 7 aa, Artificial Sequence
  Description of Artificial Sequence: Synthetic peptide
INHSGST

SEQ ID NO: 311 - protein, 11 aa, Artificial Sequence
  Description of Artificial Sequence: Synthetic peptide
AREGPYDGFDS

SEQ ID NO: 312 - protein, 8 aa, Artificial Sequence
  Description of Artificial Sequence: Synthetic peptide
SSNIGSNT

SEQ ID NO: 313 - protein, 3 aa, Artificial Sequence
  Description of Artificial Sequence: Synthetic peptide
SNN

SEQ ID NO: 314 - protein, 11 aa, Artificial Sequence
  Description of Artificial Sequence: Synthetic peptide
AAWDDSLNGYV

SEQ ID NO: 315 - protein, 8 aa, Artificial Sequence
  Description of Artificial Sequence: Synthetic peptide
GYPFNKYD

SEQ ID NO: 316 - protein, 8 aa, Artificial Sequence
  Description of Artificial Sequence: Synthetic peptide
IIPIFRTT

SEQ ID NO: 317 - protein, 9 aa, Artificial Sequence
  Description of Artificial Sequence: Synthetic peptide
AREWFYWDI

SEQ ID NO: 318 - protein, 8 aa, Artificial Sequence
  Description of Artificial Sequence: Synthetic peptide
SGSIASNY

SEQ ID NO: 319 - protein, 3 aa, Artificial Sequence
  Description of Artificial Sequence: Synthetic peptide
EDN

SEQ ID NO: 320 - protein, 10 aa, Artificial Sequence
  Description of Artificial Sequence: Synthetic peptide
QSYDSSNSVV

SEQ ID NO: 321 - protein, 8 aa, Artificial Sequence
  Description of Artificial Sequence: Synthetic peptide
GFTFSSYG

SEQ ID NO: 322 - protein, 8 aa, Artificial Sequence
  Description of Artificial Sequence: Synthetic peptide
ISHDGSNK

SEQ ID NO: 323 - protein, 14 aa, Artificial Sequence
  Description of Artificial Sequence: Synthetic peptide
ARSNQWSGYFSFDY

SEQ ID NO: 324 - protein, 6 aa, Artificial Sequence
  Description of Artificial Sequence: Synthetic peptide
KLGTKY

SEQ ID NO: 325 - protein, 10 aa, Artificial Sequence
  Description of Artificial Sequence: Synthetic peptide
QAWDSDTFVV

SEQ ID NO: 326 - protein, 8 aa, Artificial Sequence
  Description of Artificial Sequence: Synthetic peptide
GYTFTNYG

SEQ ID NO: 327 - protein, 8 aa, Artificial Sequence
  Description of Artificial Sequence: Synthetic peptide
ISAYNGNT

SEQ ID NO: 328 - protein, 10 aa, Artificial Sequence
  Description of Artificial Sequence: Synthetic peptide
ARSYFGSHDY

SEQ ID NO: 329 - protein, 6 aa, Artificial Sequence
  Description of Artificial Sequence: Synthetic peptide
NIGSKS

SEQ ID NO: 330 - protein, 3 aa, Artificial Sequence
  Description of Artificial Sequence: Synthetic peptide
YDS

SEQ ID NO: 331 - protein, 12 aa, Artificial Sequence
  Description of Artificial Sequence: Synthetic peptide
QVWDSSSDHPYV

SEQ ID NO: 332 - protein, 8 aa, Artificial Sequence
  Description of Artificial Sequence: Synthetic peptide
GYTFTTYG

SEQ ID NO: 333 - protein, 8 aa, Artificial Sequence
  Description of Artificial Sequence: Synthetic peptide
INTYNGHT

SEQ ID NO: 334 - protein, 10 aa, Artificial Sequence
  Description of Artificial Sequence: Synthetic peptide
ARVIYGSGDY

SEQ ID NO: 335 - protein, 9 aa, Artificial Sequence
  Description of Artificial Sequence: Synthetic peptide
GYSISSGYF

SEQ ID NO: 336 - protein, 7 aa, Artificial Sequence
  Description of Artificial Sequence: Synthetic peptide
IYHSRST

SEQ ID NO: 337 - protein, 9 aa, Artificial Sequence
  Description of Artificial Sequence: Synthetic peptide
ARGYGYFDY

SEQ ID NO: 338 - protein, 6 aa, Artificial Sequence
  Description of Artificial Sequence: Synthetic peptide
NIGSKT

SEQ ID NO: 339 - protein, 11 aa, Artificial Sequence
  Description of Artificial Sequence: Synthetic peptide
QVWDSSSDHRV

SEQ ID NO: 340 - protein, 8 aa, Artificial Sequence
  Description of Artificial Sequence: Synthetic peptide
GFTFGDYG

SEQ ID NO: 341 - protein, 8 aa, Artificial Sequence
  Description of Artificial Sequence: Synthetic peptide
INWNGGST

SEQ ID NO: 342 - protein, 13 aa, Artificial Sequence
  Description of Artificial Sequence: Synthetic peptide
ARSKYNFHVYYDY

SEQ ID NO: 343 - protein, 9 aa, Artificial Sequence
  Description of Artificial Sequence: Synthetic peptide
SSDVGGYNY

SEQ ID NO: 344 - protein, 3 aa, Artificial Sequence
  Description of Artificial Sequence: Synthetic peptide
DVS

SEQ ID NO: 345 - protein, 11 aa, Artificial Sequence
  Description of Artificial Sequence: Synthetic peptide
SSYTSSSTSKV

SEQ ID NO: 346 - protein, 8 aa, Artificial Sequence
  Description of Artificial Sequence: Synthetic peptide
GYTFTSYG

SEQ ID NO: 347 - protein, 13 aa, Artificial Sequence
  Description of Artificial Sequence: Synthetic peptide
ARSSGNMVSWKDM

SEQ ID NO: 348 - protein, 8 aa, Artificial Sequence
  Description of Artificial Sequence: Synthetic peptide
NSNIGSNY

SEQ ID NO: 349 - protein, 3 aa, Artificial Sequence
  Description of Artificial Sequence: Synthetic peptide
RNN

SEQ ID NO: 350 - protein, 11 aa, Artificial Sequence
  Description of Artificial Sequence: Synthetic peptide
AAWDDSLSAYV

SEQ ID NO: 351 - protein, 9 aa, Artificial Sequence
  Description of Artificial Sequence: Synthetic peptide
ARGAVAYHD

SEQ ID NO: 352 - protein, 9 aa, Artificial Sequence
  Description of Artificial Sequence: Synthetic peptide
SSDVGGYNS

SEQ ID NO: 353 - protein, 11 aa, Artificial Sequence
  Description of Artificial Sequence: Synthetic peptide
SSYTSSSTPLV

SEQ ID NO: 354 - protein, 8 aa, Artificial Sequence
  Description of Artificial Sequence: Synthetic peptide
GGTLSSYA

SEQ ID NO: 355 - protein, 8 aa, Artificial Sequence
  Description of Artificial Sequence: Synthetic peptide
IIPMFGTA

SEQ ID NO: 356 - protein, 11 aa, Artificial Sequence
  Description of Artificial Sequence: Synthetic peptide
ARGVHYASFDH

SEQ ID NO: 357 - protein, 8 aa, Artificial Sequence
  Description of Artificial Sequence: Synthetic peptide
SSNISIYD

SEQ ID NO: 358 - protein, 3 aa, Artificial Sequence
  Description of Artificial Sequence: Synthetic peptide
GNN

SEQ ID NO: 359 - protein, 11 aa, Artificial Sequence
  Description of Artificial Sequence: Synthetic peptide
GTWDDSLSGGV

SEQ ID NO: 360 - protein, 8 aa, Artificial Sequence
  Description of Artificial Sequence: Synthetic peptide
GFPFNIFG

SEQ ID NO: 361 - protein, 8 aa, Artificial Sequence
  Description of Artificial Sequence: Synthetic peptide
ISGYNGNT

SEQ ID NO: 362 - protein, 10 aa, Artificial Sequence
  Description of Artificial Sequence: Synthetic peptide
ARGAYGGMDT

SEQ ID NO: 363 - protein, 8 aa, Artificial Sequence
  Description of Artificial Sequence: Synthetic peptide
DSNIGNNY

SEQ ID NO: 364 - protein, 3 aa, Artificial Sequence
  Description of Artificial Sequence: Synthetic peptide
DVK

SEQ ID NO: 365 - protein, 11 aa, Artificial Sequence
  Description of Artificial Sequence: Synthetic peptide
GTWDSRLDAYV

SEQ ID NO: 366 - protein, 8 aa, Artificial Sequence
  Description of Artificial Sequence: Synthetic peptide
GYMFTSYG

SEQ ID NO: 367 - protein, 8 aa, Artificial Sequence
  Description of Artificial Sequence: Synthetic peptide
ISANNGKT

SEQ ID NO: 368 - protein, 11 aa, Artificial Sequence
  Description of Artificial Sequence: Synthetic peptide
ARHIGGSYFDR

SEQ ID NO: 369 - protein, 9 aa, Artificial Sequence
  Description of Artificial Sequence: Synthetic peptide
TSNIGAGYD

SEQ ID NO: 370 - protein, 3 aa, Artificial Sequence
  Description of Artificial Sequence: Synthetic peptide
TNN

SEQ ID NO: 371 - protein, 11 aa, Artificial Sequence
  Description of Artificial Sequence: Synthetic peptide
GTWDSSLSAVV

SEQ ID NO: 372 - protein, 8 aa, Artificial Sequence
  Description of Artificial Sequence: Synthetic peptide
GFTFSSYA

SEQ ID NO: 373 - protein, 8 aa, Artificial Sequence
  Description of Artificial Sequence: Synthetic peptide
ISGSDGST

SEQ ID NO: 374 - protein, 12 aa, Artificial Sequence
  Description of Artificial Sequence: Synthetic peptide
ARSHEANLVGDW

SEQ ID NO: 375 - protein, 11 aa, Artificial Sequence
  Description of Artificial Sequence: Synthetic peptide
QVWDSSSDHYV

SEQ ID NO: 376 - protein, 11 aa, Artificial Sequence
  Description of Artificial Sequence: Synthetic peptide
ARWGGFGAVDH

SEQ ID NO: 377 - protein, 10 aa, Artificial Sequence
  Description of Artificial Sequence: Synthetic peptide
QVWDSSSDVV

SEQ ID NO: 378 - protein, 8 aa, Artificial Sequence
  Description of Artificial Sequence: Synthetic peptide
GFTFSSYS

SEQ ID NO: 379 - protein, 8 aa, Artificial Sequence
  Description of Artificial Sequence: Synthetic peptide
ISSSSSYI

SEQ ID NO: 380 - protein, 8 aa, Artificial Sequence
  Description of Artificial Sequence: Synthetic peptide
ARGQGYDY

SEQ ID NO: 381 - protein, 6 aa, Artificial Sequence
  Description of Artificial Sequence: Synthetic peptide
SLTDYH

SEQ ID NO: 382 - protein, 3 aa, Artificial Sequence
  Description of Artificial Sequence: Synthetic peptide
ATN

SEQ ID NO: 383 - protein, 11 aa, Artificial Sequence
  Description of Artificial Sequence: Synthetic peptide
NSRDSGTDEVL

SEQ ID NO: 384 - protein, 9 aa, Artificial Sequence
  Description of Artificial Sequence: Synthetic peptide
ARYYPGMDM

SEQ ID NO: 385 - protein, 3 aa, Artificial Sequence
  Description of Artificial Sequence: Synthetic peptide
DDS

SEQ ID NO: 386 - protein, 11 aa, Artificial Sequence
  Description of Artificial Sequence: Synthetic peptide
QVWDSSSDHTV

SEQ ID NO: 387 - protein, 8 aa, Artificial Sequence
  Description of Artificial Sequence: Synthetic peptide
GYTLNELS

SEQ ID NO: 388 - protein, 8 aa, Artificial Sequence
  Description of Artificial Sequence: Synthetic peptide
FDPEDGET

SEQ ID NO: 389 - protein, 8 aa, Artificial Sequence
  Description of Artificial Sequence: Synthetic peptide
ARGGYGDS

SEQ ID NO: 390 - protein, 8 aa, Artificial Sequence
  Description of Artificial Sequence: Synthetic peptide
SSNIGRNG

SEQ ID NO: 391 - protein, 3 aa, Artificial Sequence
  Description of Artificial Sequence: Synthetic peptide
NDN

SEQ ID NO: 392 - protein, 11 aa, Artificial Sequence
  Description of Artificial Sequence: Synthetic peptide
AAWDDSLHGVV

SEQ ID NO: 393 - protein, 8 aa, Artificial Sequence
  Description of Artificial Sequence: Synthetic peptide
GGTFSSDA

SEQ ID NO: 394 - protein, 25 aa, Artificial Sequence
  Description of Artificial Sequence: Synthetic peptide
AREGYYYPSAYLGSVLNDISSVYDE

SEQ ID NO: 395 - protein, 10 aa, Artificial Sequence
  Description of Artificial Sequence: Synthetic peptide
QSYDSSNSWV

SEQ ID NO: 396 - protein, 9 aa, Artificial Sequence
  Description of Artificial Sequence: Synthetic peptide
ARSMTSFDY

SEQ ID NO: 397 - protein, 8 aa, Artificial Sequence
  Description of Artificial Sequence: Synthetic peptide
TSNIGNND

SEQ ID NO: 398 - protein, 3 aa, Artificial Sequence
  Description of Artificial Sequence: Synthetic peptide
DNN

SEQ ID NO: 399 - protein, 10 aa, Artificial Sequence
  Description of Artificial Sequence: Synthetic peptide
GTWDSSVSAS

SEQ ID NO: 400 - protein, 9 aa, Artificial Sequence
  Description of Artificial Sequence: Synthetic peptide
ARSVYDLDT

SEQ ID NO: 401 - protein, 8 aa, Artificial Sequence
  Description of Artificial Sequence: Synthetic peptide
NSNIGNNY

SEQ ID NO: 402 - protein, 12 aa, Artificial Sequence
  Description of Artificial Sequence: Synthetic peptide
GTWNTTVTPGYV

SEQ ID NO: 403 - protein, 8 aa, Artificial Sequence
  Description of Artificial Sequence: Synthetic peptide
GFTFDDYA

SEQ ID NO: 404 - protein, 8 aa, Artificial Sequence
  Description of Artificial Sequence: Synthetic peptide
ISWNSGSI

SEQ ID NO: 405 - protein, 12 aa, Artificial Sequence
  Description of Artificial Sequence: Synthetic peptide
ARYRQVGSAYDS

SEQ ID NO: 406 - protein, 8 aa, Artificial Sequence
  Description of Artificial Sequence: Synthetic peptide
SSNIGNNY

SEQ ID NO: 407 - protein, 12 aa, Artificial Sequence
  Description of Artificial Sequence: Synthetic peptide
GTWDSSLGAPYV

SEQ ID NO: 408 - protein, 11 aa, Artificial Sequence
  Description of Artificial Sequence: Synthetic peptide
ARYWGFGVSDR

SEQ ID NO: 409 - protein, 3 aa, Artificial Sequence
  Description of Artificial Sequence: Synthetic peptide
ADS

SEQ ID NO: 410 - protein, 12 aa, Artificial Sequence
  Description of Artificial Sequence: Synthetic peptide
QVWDSSSYHNYV

SEQ ID NO: 411 - protein, 8 aa, Artificial Sequence
  Description of Artificial Sequence: Synthetic peptide
GGTFSSYA

SEQ ID NO: 412 - protein, 8 aa, Artificial Sequence
  Description of Artificial Sequence: Synthetic peptide
IIPIFGTA

SEQ ID NO: 413 - protein, 10 aa, Artificial Sequence
  Description of Artificial Sequence: Synthetic peptide
ARYNYYYYDS

SEQ ID NO: 414 - protein, 10 aa, Artificial Sequence
  Description of Artificial Sequence: Synthetic peptide
QSYDSSNLWV

SEQ ID NO: 415 - protein, 11 aa, Artificial Sequence
  Description of Artificial Sequence: Synthetic peptide
ARYWGYDSYDE

SEQ ID NO: 416 - protein, 6 aa, Artificial Sequence
  Description of Artificial Sequence: Synthetic peptide
QSISSY

SEQ ID NO: 417 - protein, 3 aa, Artificial Sequence
  Description of Artificial Sequence: Synthetic peptide
AAS

SEQ ID NO: 418 - protein, 9 aa, Artificial Sequence
  Description of Artificial Sequence: Synthetic peptide
QQSYSTPFT

SEQ ID NO: 419 - protein, 9 aa, Artificial Sequence
  Description of Artificial Sequence: Synthetic peptide
QSYDSSNWV

SEQ ID NO: 420 - protein, 8 aa, Artificial Sequence
  Description of Artificial Sequence: Synthetic peptide
GYTFTDYY

SEQ ID NO: 421 - protein, 8 aa, Artificial Sequence
  Description of Artificial Sequence: Synthetic peptide
VDPEDGET

SEQ ID NO: 422 - protein, 19 aa, Artificial Sequence
  Description of Artificial Sequence: Synthetic peptide
ARYWSYSFDYLYMPEGNDW

SEQ ID NO: 423 - protein, 9 aa, Artificial Sequence
  Description of Artificial Sequence: Synthetic peptide
SSNIGAGYD

SEQ ID NO: 424 - protein, 11 aa, Artificial Sequence
  Description of Artificial Sequence: Synthetic peptide
QSYDSSLSDVV

SEQ ID NO: 425 - protein, 8 aa, Artificial Sequence
  Description of Artificial Sequence: Synthetic peptide
GYNFLNYG

SEQ ID NO: 426 - protein, 8 aa, Artificial Sequence
  Description of Artificial Sequence: Synthetic peptide
ISTYTGNT

SEQ ID NO: 427 - protein, 12 aa, Artificial Sequence
  Description of Artificial Sequence: Synthetic peptide
ARDLYYYEGVDY

SEQ ID NO: 428 - protein, 8 aa, Artificial Sequence
  Description of Artificial Sequence: Synthetic peptide
VSNIGSGA

SEQ ID NO: 429 - protein, 3 aa, Artificial Sequence
  Description of Artificial Sequence: Synthetic peptide
SYN

SEQ ID NO: 430 - protein, 9 aa, Artificial Sequence
  Description of Artificial Sequence: Synthetic peptide
ATWDDSVNG

SEQ ID NO: 431 - protein, 8 aa, Artificial Sequence
  Description of Artificial Sequence: Synthetic peptide
ISYDGSNK

SEQ ID NO: 432 - protein, 12 aa, Artificial Sequence
  Description of Artificial Sequence: Synthetic peptide
ARSYFTSGFYDY

SEQ ID NO: 433 - protein, 6 aa, Artificial Sequence
  Description of Artificial Sequence: Synthetic peptide
NIGSES

SEQ ID NO: 434 - protein, 3 aa, Artificial Sequence
  Description of Artificial Sequence: Synthetic peptide
YDT

SEQ ID NO: 435 - protein, 11 aa, Artificial Sequence
  Description of Artificial Sequence: Synthetic peptide
QVWDSSRDHVV

SEQ ID NO: 436 - protein, 8 aa, Artificial Sequence
  Description of Artificial Sequence: Synthetic peptide
GYTLTELS

SEQ ID NO: 437 - protein, 9 aa, Artificial Sequence
  Description of Artificial Sequence: Synthetic peptide
ARMSSMYYD

SEQ ID NO: 438 - protein, 3 aa, Artificial Sequence
  Description of Artificial Sequence: Synthetic peptide
GNS

SEQ ID NO: 439 - protein, 12 aa, Artificial Sequence
  Description of Artificial Sequence: Synthetic peptide
QSYDSSLSGSYV

SEQ ID NO: 440 - protein, 8 aa, Artificial Sequence
  Description of Artificial Sequence: Synthetic peptide
GFTVSDYY

SEQ ID NO: 441 - protein, 8 aa, Artificial Sequence
  Description of Artificial Sequence: Synthetic peptide
ISGSGNSI

SEQ ID NO: 442 - protein, 8 aa, Artificial Sequence
  Description of Artificial Sequence: Synthetic peptide
ARSTKFDY

SEQ ID NO: 443 - protein, 10 aa, Artificial Sequence
  Description of Artificial Sequence: Synthetic peptide
QVWDSSSDYV

SEQ ID NO: 444 - protein, 8 aa, Artificial Sequence
  Description of Artificial Sequence: Synthetic peptide
GYSFTNYW

SEQ ID NO: 445 - protein, 8 aa, Artificial Sequence
  Description of Artificial Sequence: Synthetic peptide
IYPGDSDT

SEQ ID NO: 446 - protein, 12 aa, Artificial Sequence
  Description of Artificial Sequence: Synthetic peptide
ARSTGSSHMSDE

SEQ ID NO: 447 - protein, 8 aa, Artificial Sequence
  Description of Artificial Sequence: Synthetic peptide
SSNVGSYT

SEQ ID NO: 448 - protein, 3 aa, Artificial Sequence
  Description of Artificial Sequence: Synthetic peptide
NNN

SEQ ID NO: 449 - protein, 11 aa, Artificial Sequence
  Description of Artificial Sequence: Synthetic peptide
AAWDDRLGGYV

SEQ ID NO: 450 - protein, 7 aa, Artificial Sequence
  Description of Artificial Sequence: Synthetic peptide
ITHSGRS

SEQ ID NO: 451 - protein, 9 aa, Artificial Sequence
  Description of Artificial Sequence: Synthetic peptide
ARSSIMSDY

SEQ ID NO: 452 - protein, 10 aa, Artificial Sequence
  Description of Artificial Sequence: Synthetic peptide
QSYDSSNHWV

SEQ ID NO: 453 - protein, 11 aa, Artificial Sequence
  Description of Artificial Sequence: Synthetic peptide
ARGSALDHYDR

SEQ ID NO: 454 - protein, 3 aa, Artificial Sequence
  Description of Artificial Sequence: Synthetic peptide
NNR

SEQ ID NO: 455 - protein, 11 aa, Artificial Sequence
  Description of Artificial Sequence: Synthetic peptide
GTWDGSLTGAV

SEQ ID NO: 456 - protein, 10 aa, Artificial Sequence
  Description of Artificial Sequence: Synthetic peptide
ARYNYYFNDY

SEQ ID NO: 457 - protein, 9 aa, Artificial Sequence
  Description of Artificial Sequence: Synthetic peptide
QSYDSTNWV

SEQ ID NO: 458 - protein, 10 aa, Artificial Sequence
  Description of Artificial Sequence: Synthetic peptide
ARSMFGAHDS

SEQ ID NO: 459 - protein, 11 aa, Artificial Sequence
  Description of Artificial Sequence: Synthetic peptide
ARGASFDRHDN

SEQ ID NO: 460 - protein, 9 aa, Artificial Sequence
  Description of Artificial Sequence: Synthetic peptide
SSNIGAGFD

SEQ ID NO: 461 - protein, 3 aa, Artificial Sequence
  Description of Artificial Sequence: Synthetic peptide
ANS

SEQ ID NO: 462 - protein, 11 aa, Artificial Sequence
  Description of Artificial Sequence: Synthetic peptide
QSYDSSLSGVV

SEQ ID NO: 463 - protein, 10 aa, Artificial Sequence
  Description of Artificial Sequence: Synthetic peptide
ARSNYYYNDY

SEQ ID NO: 464 - protein, 9 aa, Artificial Sequence
  Description of Artificial Sequence: Synthetic peptide
ARYSGVYYD

SEQ ID NO: 465 - protein, 11 aa, Artificial Sequence
  Description of Artificial Sequence: Synthetic peptide
QSYDSSLSGYV

SEQ ID NO: 466 - protein, 8 aa, Artificial Sequence
  Description of Artificial Sequence: Synthetic peptide
MNPNSGNT

SEQ ID NO: 467 - protein, 9 aa, Artificial Sequence
  Description of Artificial Sequence: Synthetic peptide
ARYYSYGYD

SEQ ID NO: 468 - protein, 8 aa, Artificial Sequence
  Description of Artificial Sequence: Synthetic peptide
SGSIADNF

SEQ ID NO: 469 - protein, 3 aa, Artificial Sequence
  Description of Artificial Sequence: Synthetic peptide
NDD

SEQ ID NO: 470 - protein, 10 aa, Artificial Sequence
  Description of Artificial Sequence: Synthetic peptide
QSYDNNNRGV

SEQ ID NO: 471 - protein, 10 aa, Artificial Sequence
  Description of Artificial Sequence: Synthetic peptide
GDSVSTNSVA

SEQ ID NO: 472 - protein, 9 aa, Artificial Sequence
  Description of Artificial Sequence: Synthetic peptide
TYYRSKWSN

SEQ ID NO: 473 - protein, 12 aa, Artificial Sequence
  Description of Artificial Sequence: Synthetic peptide
ARSSSWYQIFDY

SEQ ID NO: 474 - protein, 9 aa, Artificial Sequence
  Description of Artificial Sequence: Synthetic peptide
SSNIGTGYF

SEQ ID NO: 475 - protein, 8 aa, Artificial Sequence
  Description of Artificial Sequence: Synthetic peptide
ISGSGGST

SEQ ID NO: 476 - protein, 14 aa, Artificial Sequence
  Description of Artificial Sequence: Synthetic peptide
ARSGAYWDYSVYDE

SEQ ID NO: 477 - protein, 8 aa, Artificial Sequence
  Description of Artificial Sequence: Synthetic peptide
SDSIANNY

SEQ ID NO: 478 - protein, 3 aa, Artificial Sequence
  Description of Artificial Sequence: Synthetic peptide
EDV

SEQ ID NO: 479 - protein, 10 aa, Artificial Sequence
  Description of Artificial Sequence: Synthetic peptide
QSYHSDNRWV

SEQ ID NO: 480 - protein, 9 aa, Artificial Sequence
  Description of Artificial Sequence: Synthetic peptide
GGSISSSNW

SEQ ID NO: 481 - protein, 7 aa, Artificial Sequence
  Description of Artificial Sequence: Synthetic peptide
IYHSGSP

SEQ ID NO: 482 - protein, 12 aa, Artificial Sequence
  Description of Artificial Sequence: Synthetic peptide
ARMTTHTFGYDA

SEQ ID NO: 483 - protein, 6 aa, Artificial Sequence
  Description of Artificial Sequence: Synthetic peptide
KLGDKY

SEQ ID NO: 484 - protein, 3 aa, Artificial Sequence
  Description of Artificial Sequence: Synthetic peptide
QDN

SEQ ID NO: 485 - protein, 10 aa, Artificial Sequence
  Description of Artificial Sequence: Synthetic peptide
QAWDSSTYVA

SEQ ID NO: 486 - protein, 8 aa, Artificial Sequence
  Description of Artificial Sequence: Synthetic peptide
ARGVHLDW

SEQ ID NO: 487 - protein, 3 aa, Artificial Sequence
  Description of Artificial Sequence: Synthetic peptide
DDA

SEQ ID NO: 488 - protein, 11 aa, Artificial Sequence
  Description of Artificial Sequence: Synthetic peptide
QVWDRNSAQFV

SEQ ID NO: 489 - protein, 19 aa, Artificial Sequence
  Description of Artificial Sequence: Synthetic peptide
ARLYEGGYHGWGSWLSSDS

SEQ ID NO: 490 - protein, 8 aa, Artificial Sequence
  Description of Artificial Sequence: Synthetic peptide
SSNIGSNY

SEQ ID NO: 491 - protein, 11 aa, Artificial Sequence
  Description of Artificial Sequence: Synthetic peptide
AAWDDSLSGYV

SEQ ID NO: 492 - protein, 11 aa, Artificial Sequence
  Description of Artificial Sequence: Synthetic peptide
AREGAFDAFDI

SEQ ID NO: 493 - protein, 10 aa, Artificial Sequence
  Description of Artificial Sequence: Synthetic peptide
AAWDDSLNGY

SEQ ID NO: 494 - protein, 13 aa, Artificial Sequence
  Description of Artificial Sequence: Synthetic peptide
ANGDSNYYYGMDV

SEQ ID NO: 495 - protein, 11 aa, Artificial Sequence
  Description of Artificial Sequence: Synthetic peptide
AAWDDSLSGYL

SEQ ID NO: 496 - protein, 8 aa, Artificial Sequence
  Description of Artificial Sequence: Synthetic peptide
ISGDGGST

SEQ ID NO: 497 - protein, 16 aa, Artificial Sequence
  Description of Artificial Sequence: Synthetic peptide
AKDRAAAGYYYYGMDV

SEQ ID NO: 498 - protein, 9 aa, Artificial Sequence
  Description of Artificial Sequence: Synthetic peptide
SSDIGGYNY

SEQ ID NO: 499 - protein, 11 aa, Artificial Sequence
  Description of Artificial Sequence: Synthetic peptide
ISYTRTWNPYV

SEQ ID NO: 500 - protein, 8 aa, Artificial Sequence
  Description of Artificial Sequence: Synthetic peptide
GFTFNDYA

SEQ ID NO: 501 - protein, 8 aa, Artificial Sequence
  Description of Artificial Sequence: Synthetic peptide
ISWSGNNI

SEQ ID NO: 502 - protein, 16 aa, Artificial Sequence
  Description of Artificial Sequence: Synthetic peptide
AKDSIRYGITWGGFDY

SEQ ID NO: 503 - protein, 6 aa, Artificial Sequence
  Description of Artificial Sequence: Synthetic peptide
KLGEKY

SEQ ID NO: 504 - protein, 3 aa, Artificial Sequence
  Description of Artificial Sequence: Synthetic peptide
QDT

SEQ ID NO: 505 - protein, 8 aa, Artificial Sequence
  Description of Artificial Sequence: Synthetic peptide
QAWDRGVV

SEQ ID NO: 506 - protein, 8 aa, Artificial Sequence
  Description of Artificial Sequence: Synthetic peptide
INWDGGST

SEQ ID NO: 507 - protein, 11 aa, Artificial Sequence
  Description of Artificial Sequence: Synthetic peptide
AKGMGLRAFDY

SEQ ID NO: 508 - protein, 8 aa, Artificial Sequence
  Description of Artificial Sequence: Synthetic peptide
SNNVGNLG

SEQ ID NO: 509 - protein, 9 aa, Artificial Sequence
  Description of Artificial Sequence: Synthetic peptide
SAWDSSLSA

SEQ ID NO: 510 - protein, 8 aa, Artificial Sequence
  Description of Artificial Sequence: Synthetic peptide
GYTFSWYA

SEQ ID NO: 511 - protein, 8 aa, Artificial Sequence
  Description of Artificial Sequence: Synthetic peptide
INAGNGNT

SEQ ID NO: 512 - protein, 15 aa, Artificial Sequence
  Description of Artificial Sequence: Synthetic peptide
ARPDNYGSGGDVFDI

SEQ ID NO: 513 - protein, 3 aa, Artificial Sequence
  Description of Artificial Sequence: Synthetic peptide
SND

SEQ ID NO: 514 - protein, 12 aa, Artificial Sequence
  Description of Artificial Sequence: Synthetic peptide
ASWDDSLNGRYV

SEQ ID NO: 515 - protein, 8 aa, Artificial Sequence
  Description of Artificial Sequence: Synthetic peptide
GFTFSSYE

SEQ ID NO: 516 - protein, 8 aa, Artificial Sequence
  Description of Artificial Sequence: Synthetic peptide
ISSSGSTI

SEQ ID NO: 517 - protein, 9 aa, Artificial Sequence
  Description of Artificial Sequence: Synthetic peptide
ARWDYGMDV

SEQ ID NO: 518 - protein, 8 aa, Artificial Sequence
  Description of Artificial Sequence: Synthetic peptide
SGSIASNF

SEQ ID NO: 519 - protein, 9 aa, Artificial Sequence
  Description of Artificial Sequence: Synthetic peptide
QSYDTSNVV

SEQ ID NO: 520 - protein, 8 aa, Artificial Sequence
  Description of Artificial Sequence: Synthetic peptide
GYTFTWYA

SEQ ID NO: 521 - protein, 8 aa, Artificial Sequence
  Description of Artificial Sequence: Synthetic peptide
INAGSGNT

SEQ ID NO: 522 - protein, 15 aa, Artificial Sequence
  Description of Artificial Sequence: Synthetic peptide
ARPNNYGSGGDVFDI

SEQ ID NO: 523 - protein, 3 aa, Artificial Sequence
  Description of Artificial Sequence: Synthetic peptide
SSS

SEQ ID NO: 524 - protein, 9 aa, Artificial Sequence
  Description of Artificial Sequence: Synthetic peptide
ATWDDSLNA

SEQ ID NO: 525 - protein, 8 aa, Artificial Sequence
  Description of Artificial Sequence: Synthetic peptide
GYTFTNYA

SEQ ID NO: 526 - protein, 8 aa, Artificial Sequence
  Description of Artificial Sequence: Synthetic peptide
INGGNGNT

SEQ ID NO: 527 - protein, 14 aa, Artificial Sequence
  Description of Artificial Sequence: Synthetic peptide
AKPEETAGTIHFDY

SEQ ID NO: 528 - protein, 11 aa, Artificial Sequence
  Description of Artificial Sequence: Synthetic peptide
GTWDSSLSAYV

SEQ ID NO: 529 - protein, 19 aa, Artificial Sequence
  Description of Artificial Sequence: Synthetic peptide
AGEGYYDSSGYSNGDAFDI

SEQ ID NO: 530 - protein, 9 aa, Artificial Sequence
  Description of Artificial Sequence: Synthetic peptide
QSYDSTITV

SEQ ID NO: 531 - protein, 9 aa, Artificial Sequence
  Description of Artificial Sequence: Synthetic peptide
QSYDSSNVV

SEQ ID NO: 532 - protein, 16 aa, Artificial Sequence
  Description of Artificial Sequence: Synthetic peptide
AKDRGGGVIVKDAFDI

SEQ ID NO: 533 - protein, 6 aa, Artificial Sequence
  Description of Artificial Sequence: Synthetic peptide
RLTNKY

SEQ ID NO: 534 - protein, 3 aa, Artificial Sequence
  Description of Artificial Sequence: Synthetic peptide
EDA

SEQ ID NO: 535 - protein, 9 aa, Artificial Sequence
  Description of Artificial Sequence: Synthetic peptide
QAWDSSVVV

SEQ ID NO: 536 - protein, 11 aa, Artificial Sequence
  Description of Artificial Sequence: Synthetic peptide
ARQQGGGWYDV

SEQ ID NO: 537 - protein, 8 aa, Artificial Sequence
  Description of Artificial Sequence: Synthetic peptide
GYTFTSYT

SEQ ID NO: 538 - protein, 8 aa, Artificial Sequence
  Description of Artificial Sequence: Synthetic peptide
ISTYNGLT

SEQ ID NO: 539 - protein, 16 aa, Artificial Sequence
  Description of Artificial Sequence: Synthetic peptide
VREGSPDYGDFASFDY

SEQ ID NO: 540 - protein, 8 aa, Artificial Sequence
  Description of Artificial Sequence: Synthetic peptide
NFNVGNND

SEQ ID NO: 541 - protein, 12 aa, Artificial Sequence
  Description of Artificial Sequence: Synthetic peptide
GTWDSSLNTGGV

SEQ ID NO: 542 - protein, 12 aa, Artificial Sequence
  Description of Artificial Sequence: Synthetic peptide
GTWDTSLSGFYV

SEQ ID NO: 543 - protein, 16 aa, Artificial Sequence
  Description of Artificial Sequence: Synthetic peptide
ARDPAYGDYEYDAFDI

SEQ ID NO: 544 - protein, 8 aa, Artificial Sequence
  Description of Artificial Sequence: Synthetic peptide
TSNIGSNT

SEQ ID NO: 545 - protein, 11 aa, Artificial Sequence
  Description of Artificial Sequence: Synthetic peptide
ATWDDSLSGVV

SEQ ID NO: 546 - protein, 11 aa, Artificial Sequence
  Description of Artificial Sequence: Synthetic peptide
ARGAGFDAFDI

SEQ ID NO: 547 - protein, 8 aa, Artificial Sequence
  Description of Artificial Sequence: Synthetic peptide
SSNIGTNG

SEQ ID NO: 548 - protein, 3 aa, Artificial Sequence
  Description of Artificial Sequence: Synthetic peptide
TND

SEQ ID NO: 549 - protein, 11 aa, Artificial Sequence
  Description of Artificial Sequence: Synthetic peptide
AVWDHSLNGPV

SEQ ID NO: 550 - protein, 10 aa, Artificial Sequence
  Description of Artificial Sequence: Synthetic peptide
AREGLDAFDI

SEQ ID NO: 551 - protein, 8 aa, Artificial Sequence
  Description of Artificial Sequence: Synthetic peptide
GYSFTSYT

SEQ ID NO: 552 - protein, 8 aa, Artificial Sequence
  Description of Artificial Sequence: Synthetic peptide
VSTYNGLR

SEQ ID NO: 553 - protein, 16 aa, Artificial Sequence
  Description of Artificial Sequence: Synthetic peptide
VREGSPDYGDFAAFDY

SEQ ID NO: 554 - protein, 12 aa, Artificial Sequence
  Description of Artificial Sequence: Synthetic peptide
GTWDSSLSAAYV

SEQ ID NO: 555 - protein, 10 aa, Artificial Sequence
  Description of Artificial Sequence: Synthetic peptide
ARDGGGYFDY

SEQ ID NO: 556 - protein, 8 aa, Artificial Sequence
  Description of Artificial Sequence: Synthetic peptide
RSNIGTNI

SEQ ID NO: 557 - protein, 2 aa, Artificial Sequence
  Description of Artificial Sequence: Synthetic peptide
GS

SEQ ID NO: 558 - protein, 11 aa, Artificial Sequence
  Description of Artificial Sequence: Synthetic peptide
AAWDDSLNGPA

SEQ ID NO: 559 - protein, 8 aa, Artificial Sequence
  Description of Artificial Sequence: Synthetic peptide
GYNFISYY

SEQ ID NO: 560 - protein, 8 aa, Artificial Sequence
  Description of Artificial Sequence: Synthetic peptide
INPGSGET

SEQ ID NO: 561 - protein, 14 aa, Artificial Sequence
  Description of Artificial Sequence: Synthetic peptide
ATGLIRGASDAFNI

SEQ ID NO: 562 - protein, 9 aa, Artificial Sequence
  Description of Artificial Sequence: Synthetic peptide
SSNIGARYD

SEQ ID NO: 563 - protein, 3 aa, Artificial Sequence
  Description of Artificial Sequence: Synthetic peptide
ANY

SEQ ID NO: 564 - protein, 11 aa, Artificial Sequence
  Description of Artificial Sequence: Synthetic peptide
QSYDSSVSAWV

SEQ ID NO: 565 - protein, 10 aa, Artificial Sequence
  Description of Artificial Sequence: Synthetic peptide
GDSVSSNSAA

SEQ ID NO: 566 - protein, 9 aa, Artificial Sequence
  Description of Artificial Sequence: Synthetic peptide
TYYRSKWYN

SEQ ID NO: 567 - protein, 12 aa, Artificial Sequence
  Description of Artificial Sequence: Synthetic peptide
ARERSGWKGFDY

SEQ ID NO: 568 - protein, 6 aa, Artificial Sequence
  Description of Artificial Sequence: Synthetic peptide
KLGDKF

SEQ ID NO: 569 - protein, 9 aa, Artificial Sequence
  Description of Artificial Sequence: Synthetic peptide
QTWASGIVV

SEQ ID NO: 570 - protein, 12 aa, Artificial Sequence
  Description of Artificial Sequence: Synthetic peptide
AKWGPFQDAFDI

SEQ ID NO: 571 - protein, 11 aa, Artificial Sequence
  Description of Artificial Sequence: Synthetic peptide
QSLLERNAYNY

SEQ ID NO: 572 - protein, 3 aa, Artificial Sequence
  Description of Artificial Sequence: Synthetic peptide
LGS

SEQ ID NO: 573 - protein, 9 aa, Artificial Sequence
  Description of Artificial Sequence: Synthetic peptide
MQALQAPFT

SEQ ID NO: 574 - protein, 16 aa, Artificial Sequence
  Description of Artificial Sequence: Synthetic peptide
AKARWTAVASDHHFDY

SEQ ID NO: 575 - protein, 3 aa, Artificial Sequence
  Description of Artificial Sequence: Synthetic peptide
EVS

SEQ ID NO: 576 - protein, 11 aa, Artificial Sequence
  Description of Artificial Sequence: Synthetic peptide
SSYTSSSTPYV

SEQ ID NO: 577 - protein, 9 aa, Artificial Sequence
  Description of Artificial Sequence: Synthetic peptide
ARDWDYMDV

SEQ ID NO: 578 - protein, 20 aa, Artificial Sequence
  Description of Artificial Sequence: Synthetic peptide
ARDLSRGANPHYYYYYGMDV

SEQ ID NO: 579 - protein, 18 aa, Artificial Sequence
  Description of Artificial Sequence: Synthetic peptide
ATESNLVSRHYYYYGMDV

SEQ ID NO: 580 - protein, 9 aa, Artificial Sequence
  Description of Artificial Sequence: Synthetic peptide
RSNIGAGYD

SEQ ID NO: 581 - protein, 13 aa, Artificial Sequence
  Description of Artificial Sequence: Synthetic peptide
QSYDNTVRESPYV

SEQ ID NO: 582 - protein, 8 aa, Artificial Sequence
  Description of Artificial Sequence: Synthetic peptide
GYTFTGYY

SEQ ID NO: 583 - protein, 8 aa, Artificial Sequence
  Description of Artificial Sequence: Synthetic peptide
INPNSGGT

SEQ ID NO: 584 - protein, 25 aa, Artificial Sequence
  Description of Artificial Sequence: Synthetic peptide
ARDYGYYGSGSYSSGPLYYYYGMDV

SEQ ID NO: 585 - protein, 8 aa, Artificial Sequence
  Description of Artificial Sequence: Synthetic peptide
SSNIGSNS

SEQ ID NO: 586 - protein, 3 aa, Artificial Sequence
  Description of Artificial Sequence: Synthetic peptide
NND

SEQ ID NO: 587 - protein, 16 aa, Artificial Sequence
  Description of Artificial Sequence: Synthetic peptide
AKDITYGSGSYGAFDI

SEQ ID NO: 588 - protein, 6 aa, Artificial Sequence
  Description of Artificial Sequence: Synthetic peptide
DIGSKS

SEQ ID NO: 589 - protein, 8 aa, Artificial Sequence
  Description of Artificial Sequence: Synthetic peptide
GGTFSSNS

SEQ ID NO: 590 - protein, 8 aa, Artificial Sequence
  Description of Artificial Sequence: Synthetic peptide
IFPILGIT

SEQ ID NO: 591 - protein, 13 aa, Artificial Sequence
  Description of Artificial Sequence: Synthetic peptide
ARGNYQWYDAFDI

SEQ ID NO: 592 - protein, 9 aa, Artificial Sequence
  Description of Artificial Sequence: Synthetic peptide
QSYDSTSVL

SEQ ID NO: 593 - DNA, 747 bp, Artificial Sequence
  Description of Artificial Sequence: Synthetic polynucleotide
cagtctgtgttgacgcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtgtatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgcgaaggtccgtacgacggtttcgattcttggggtcaaggtactctggtgaccgtctcctca

SEQ ID NO: 594 - protein, 249 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGPYDGFDSWGQGTLVTVSS

SEQ ID NO: 595 - DNA, 747 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattctgtggtattcggcggagggaccaagctgaccgtcctaggttctagaggtggtggtggtagcggcggcggcggctctggtggtggtggatccctcgagatggcccaggtccagctggtacagtctggcactgaggtgaagaagcctggggcctcagtgagggtcgcctgcaaggcttctggttacccctttaacaaatatgacatcaactgggtgcgacaggcccctggacaagggcttgagtggatgggaggcatcatccctatctttcgtacaacaaactacgcacagaagttccagggcagagtcacgattaccgcggacgaatccacgagcacagcctacatggagctgagcagcctgagatctgaggacacggccgtatattactgtgcgcgcgaatggttctactgggatatctggggtcaaggtactctggtgaccgtctcctca

SEQ ID NO: 596 - protein, 249 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSVVFGGGTKLTVLGSRGGGGSGGGGSGGGGSLEMAQVQLVQSGTEVKKPGASVRVACKASGYPFNKYDINWVRQAPGQGLEWMGGIIPIFRTTNYAQKFQGRVTITADESTSTAYMELSSLRSEDTAVYYCAREWFYWDIWGQGTLVTVSS

SEQ ID NO: 597 - DNA, 750 bp, Artificial Sequence
  Description of Artificial Sequence: Synthetic polynucleotide
cagtctgtgttgactcagccaccctcagtgtccgtgtccccaggacagacagccagcatctcctgctctggaaataaattggggactaagtatgtttactggtatcagaagaggccaggccagtcccctgtgttggtcatgtatgaagataatcagcggccctcagggatcccggagcggttctctggctccaactctgggaacacagccactctgaccatcagagggacccagactgtggatgaggctgactattactgtcaggcgtgggactccgacactttcgtggtcttcggcggagggaccaaggtcaccgtcctaggttctagaggtggtggtggtagcggcggcggcggctctggtggtggtggatccctcgagatggccgaggtgcagctggtggagaccgggggaggcgtggtccagcctgggaggtccctgagactctcctgtgcagcctctggattcaccttcagtagttatggcatgcactgggtccgccaggctccaggcaaggggctggagtgggtggcagttatatcacatgatggaagtaataaatactacgcagactccgtgaagggccgattcaccatctccagagacaattccaaggacacgctgtatctgcaaatgaacagcctgagaggtgaggacacggccgtatattactgtgcgcgctctaaccagtggtctggttacttctctttcgattactggggtcaaggtactctggtgaccgtctcctca

SEQ ID NO: 598 - protein, 250 aa, Artificial Sequence
  Description of Artificial Sequence: Synthetic polypeptide
QSVLTQPPSVSVSPGQTASISCSGNKLGTKYVYWYQKRPGQSPVLVMYEDNQRPSGIPERFSGSNSGNTATLTIRGTQTVDEADYYCQAWDSDTFVVFGGGTKVTVLGSRGGGGSGGGGSGGGGSLEMAEVQLVETGGGVVQPGRSLRLSCAASGFTFSSYGMHWVRQAPGKGLEWVAVISHDGSNKYYADSVKGRFTISRDNSKDTLYLQMNSLRGEDTAVYYCARSNQWSGYFSFDYWGQGTLVTVSS

SEQ ID NO: 599 - DNA, 744 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtggtggtcatccattatgatagcgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggttctagaggtggtggtggtagcggcggcggcggctctggtggtggtggatccctcgagatggccgaggtgcagctggtgcagtctggagctgaggtgaagaagcctggggcctcagtgaaggtctcctgcaaggcttctggttacacctttaccacctatggtatcagctgggtgcgacaggcccctggacaagggcttgagtggatgggatggatcaacacttacaatggtcacacaaactatgcacagaagctccagggcagagccacaatgaccgcagacacatccacgaacacagcctacatggagctgaggagcctgagatctgacgacactgccgtgtattactgtgcgcgcgttatctacggttctggtgattactggggtcaaggtactctggtgaccgtctcctca

SEQ ID NO: 600 - protein, 248 aa, Artificial Sequence
  Description of Artificial Sequence: Synthetic polypeptide
SYVLTQPPSVSVAPGKTARITCGGNNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAEVQLVQSGAEVKKPGASVKVSCKASGYTFTTYGISWVRQAPGQGLEWMGWINTYNGHTNYAQKLQGRATMTADTSTNTAYMELRSLRSDDTAVYYCARVIYGSGDYWGQGTLVTVSS

SEQ ID NO: 601 - DNA, 738 bp, Artificial Sequence
  Description of Artificial Sequence: Synthetic polynucleotide
tcctatgtgctgactcagccactctcagtgtcagtggccccaggaaagacggccaggattacctgtgggggaaacaacattggaagtaaaactgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatcgggtgttcggcggagggaccaagctgaccgtcctaggttctagaggtggtggtggtagcggcggcggcggctctggtggtggtggatccctcgagatggcccaggtgcagctgcaggagtcgggcccaggactggtgaagccttcggagaccctgtccctcacctgcaatgtctctggttactccatcagcagtggttacttttggggctggatccggcagcccccagggaaggggctggagtggattgggagtatctatcatagtaggagcacctactacaacccgtccctcaagagtcgagtcaccatatcagtagacacgtccaagaaccagttctccctgaagctgaactctgtgaccgccgcagacacggccgtgtattactgtgcgcgcggttacggttacttcgattactggggtcaaggtactctggtgaccgtctcctca

SEQ ID NO: 602 - protein, 246 aa, Artificial Sequence
  Description of Artificial Sequence: Synthetic polypeptide
SYVLTQPLSVSVAPGKTARITCGGNNIGSKTVHWYQQKPGQAPVLVIYYDSDRPSGIPERFSGSNSGNTATLTISRVEAGDEADYYCQVWDSSSDHRVFGGGTKLTVLGSRGGGGSGGGGSGGGGSLEMAQVQLQESGPGLVKPSETLSLTCNVSGYSISSGYFWGWIRQPPGKGLEWIGSIYHSRSTYYNPSLKSRVTISVDTSKNQFSLKLNSVTAADTAVYYCARGYGYFDYWGQGTLVTVSS

SEQ ID NO: 603 - DNA, 759 bp, Artificial Sequence
  Description of Artificial Sequence: Synthetic polynucleotide
caatctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttcgaaggtgttcggcggagggaccaagctgaccgtcctaggttctagaggtggtggtggtagcggcggcggcggctctggtggtggtggatccctcgagatggccgaggtgcagctggtggagtctgggggaggtgtggtacggcctggggggtccctgagactctcctgtgcagcctctggattcacctttggtgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccgtatattactgtgcgcgctctaaatacaacttccatgtttactacgattactggggtcaaggtactctggtgaccgtctcctca

SEQ ID NO: 604 - protein, 253 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTSKVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSS

SEQ ID NO: 605 - DNA, 756 bp, Artificial Sequence
  Description of Artificial Sequence: Synthetic polynucleotide
cagtctgtgttgacgcagccaccctcagcgtctgggacccccgggcagacagtcaccatctcttgttctggaagcaactccaacatcggaagtaattatgtatactggtaccagcagctcccaggaacggcccccaaactcctcatctataggaataatcagcggccctcaggggtccctgaccgattctcaggctccaagtctggcacctcagcctccctggccatcagtgggctccgctccgaggatgaggctgattattactgtgcagcatgggatgacagcctgagtgcttatgtcttcggaactgggaccaaggtcaccgtcctaggttctagaggtggtggtggtagcggcggcggcggctctggtggtggtggatccctcgagatggcccaggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacactgccgtgtattactgtgcgcgctcttctggtaacatggtttcttggaaagatatgtggggtcaaggtactctggtgaccgtctcctca

SEQ ID NO: 606 - protein, 252 aa, Artificial Sequence
  Description of Artificial Sequence: Synthetic polypeptide
QSVLTQPPSASGTPGQTVTISCSGSNSNIGSNYVYWYQQLPGTAPKLLIYRNNQRPSGVPDRFSGSKSGTSASLAISGLRSEDEADYYCAAWDDSLSAYVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSSGNMVSWKDMWGQGTLVTVSS

SEQ ID NO: 607 - DNA, 747 bp, Artificial Sequence
  Description of Artificial Sequence: Synthetic polynucleotide
caatctgccctgactcagcctgcctccgtgtctgggtctcctggacagtcgatcaccatctcctgcactggaaccagcagtgacgttggtggttataactctgtctcctggtaccaacaacacccaggcaaagcccccagactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacccctttagtcttcggaactgggaccaaggtcaccgtcctaggttctagaggtggtggtggtagcggcggcggcggctctggtggtggtggatccctcgagatggcccaggtgcagctggtgcagtctggggctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgcggtgctgttgcttaccatgattggggtcaaggtactctggtgaccgtctcctca

SEQ ID NO: 608 - protein, 249 aa, Artificial Sequence
  Description of Artificial Sequence: Synthetic polypeptide
QSALTQPASVSGSPGQSITISCTGTSSDVGGYNSVSWYQQHPGKAPRLMIYDVSNRPSGVSNRFSGSKSGNTASLTISGLQAEDEADYYCSSYTSSSTPLVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSS

SEQ ID NO: 609 - DNA, 750 bp, Artificial Sequence
  Description of Artificial Sequence: Synthetic polynucleotide
cagtctgtcgtgacgcagccgccctcagtgtctgcggccccaggacagagggtcaccatctcctgctctggaagcagctccaacatttcgatttatgatgtatcctggtatcagcagctcccaggaacagcccccaaactcctcatttatggcaataataagcgaccctcggggattgctgaccgattctctggctccacgtctggcacgtcagccaccctgggcatcaccggactccagactggggacgaggccgattattactgcggaacatgggatgacagtctgagtgggggggtgttcggcggagggaccaagctgaccgtcctaggttctagaggtggtggtggtagcggcggcggcggctctggtggtggtggatccctcgagatggcccagatgcagctggtgcaatctggggctgaggtgaagaagcctgggtcctcggtgaaggtctcctgcgaggcttctggaggcaccctcagcagctatgctatcaactgggtgcgacaggcccctggacaagggcttgagtggatgggagggatcatccctatgtttggtacagcacactacgcacagaagttccagggcagagtcacgattaccgcggacgaatccacgaaaacagcctacatggagctgagcagcctgagatctgaggacactgccgtgtattactgtgcgcgcggtgttcattacgcttctttcgatcattggggtcaaggtactctggtgaccgtctcctca

SEQ ID NO: 610 - protein, 250 aa, Artificial Sequence
  Description of Artificial Sequence: Synthetic polypeptide
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLGSRGGGGSGGGGSGGGGSLEMAQMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSS

SEQ ID NO: 611 - DNA, 747 bp, Artificial Sequence
  Description of Artificial Sequence: Synthetic polynucleotide
cagtctgtgttgacgcagccgccctcagtgtctgcggccgcaggacagaaggtcaccatctcctgctctggaagcgactccaacattgggaataattatgtgtcctggtatcaacacctcccagggacagcccccaaactcctcatttatgacgttaaaaatcgaccctcagggattcctgaccggttctccggctccaagtctggctcgtcagccaccctaggcatcgccggactccagcctggggacgaggccgattattactgcggaacatgggacagtcggctggatgcctatgtcttcggaactgggaccaaggtcaccgtcctaggttctagaggtggtggtggtagcggcggcggcggctctggtggtggtggatccctcgagatggcccagatgcagctggtgcaatctggagctgaggtgaagaagcctggggcctcagtgaaggtctcctgcaagacttctggtttcccctttaatatctttggaatcacctgggtgcgacaggcccctggacaagggcttgagtggatgggatggatcagcggttacaacggtaacacagactacccacagaagttccagggcagagtcaccatgtccacagacacatccacgagtacagcctacatggagctgaggaacctgaaatctgacgacacggccgtgtattactgtgcgcgcggtgcttacggtggtatggatacttggggtcaaggtactctggtgaccgtctcctca

SEQ ID NO: 612 - protein, 249 aa, Artificial Sequence
  Description of Artificial Sequence: Synthetic polypeptide
QSVLTQPPSVSAAAGQKVTISCSGSDSNIGNNYVSWYQHLPGTAPKLLIYDVKNRPSGIPDRFSGSKSGSSATLGIAGLQPGDEADYYCGTWDSRLDAYVFGTGTKVTVLGSRGGGGSGGGGSGGGGSLEMAQMQLVQSGAEVKKPGASVKVSCKTSGFPFNIFGITWVRQAPGQGLEWMGWISGYNGNTDYPQKFQGRVTMSTDTSTSTAYMELRNLKSDDTAVYYCARGAYGGMDTWGQGTLVTVSS

SEQ ID NO: 613 - DNA, 753 bp, Artificial Sequence
  Description of Artificial Sequence: Synthetic polynucleotide
cagtctgtcgtgacgcagccgccctcagtgtctggggccccagggcagagggtcaccatctcctgcactgggagcacctccaacatcggggcaggttatgatgtacactggtatcagcagcttccaggaacagcccccaaactcctcatctatactaacaactttcggccctcaggggtccctgaccgattctctgcctccaagtctggcacttcagcttccctggccatcactggtctccaggctgaggatgaggctgattattactgcggaacatgggatagcagcctgagtgccgttgtgttcggcggagggaccaagctgaccgtcctaggttctagaggtggtggtggtagcggcggcggcggctctggtggtggtggatccctcgagatggccgaggtgcagctggtggagtctggaactgaggtgaagaagcctggggcctcagtgaaagtctcctgcaaggcttctggttacatgtttaccagttatggtctcaactgggtgcgacaggcccctggacaagggcttgagtggatgggatggatcagcgctaacaatggtaagacaaattatgctaagaaattccaggacagagtcaccatgaccagagacacttccacgagcacaggctacatggaactgaggagcctgagatctgacgacacggccgtatattactgtgcgcgccatatcggtggttcttacttcgatcgttggggtcaaggtactctggtgaccgtctcctca

SEQ ID NO: 614 - protein, 251 aa, Artificial Sequence
  Description of Artificial Sequence: Synthetic polypeptide
QSVVTQPPSVSGAPGQRVTISCTGSTSNIGAGYDVHWYQQLPGTAPKLLIYTNNFRPSGVPDRFSASKSGTSASLAITGLQAEDEADYYCGTWDSSLSAVVFGGGTKLTVLGSRGGGGSGGGGSGGGGSLEMAEVQLVESGTEVKKPGASVKVSCKASGYMFTSYGLNWVRQAPGQGLEWMGWISANNGKTNYAKKFQDRVTMTRDTSTSTGYMELRSLRSDDTAVYYCARHIGGSYFDRWGQGTLVTVSS

SEQ ID NO: 615 - DNA, 747 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcattatgtcttcggaactgggaccaaggtcaccgtcctaggttctagaggtggtggtggtagcggcggcggcggctctggtggtggtggatccctcgagatggccgaggtgcagctggtggagactgggggaggcttggtacagcctggggggtccctgagactctcctgtgcagcctctggattcacctttagcagctatgccatgagctgggtccgccaggctccagggaaggggctggagtgggtctcagctattagtggtagtgatggtagcacatactacgcagactccgtgaagggccggttcaccatctccagagacaattccaagaacacgctgtatctgcaaatgaacagcctgagagacgaggacacggccgtatattactgtgcgcgctctcatgaagctaacctggttggtgattggtggggtcaaggtactctggtgaccgtctcctca

SEQ ID NO: 616 - protein, 249 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKVTVLGSRGGGGSGGGGSGGGGSLEMAEVQLVETGGGLVQPGGSLRLSCAASGFTFSSYAMSWVRQAPGKGLEWVSAISGSDGSTYYADSVKGRFTISRDNSKNTLYLQMNSLRDEDTAVYYCARSHEANLVGDWWGQGTLVTVSS

SEQ ID NO: 617 - DNA, 741 bp, Artificial Sequence
  Description of Artificial Sequence: Synthetic polynucleotide
cagtctgtggtgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatgtggtattcggcggagggaccaagctgaccgtcctaggttctagaggtggtggtggtagcggcggcggcggctctggtggtggtggatccctcgagatggccgaggtccagctggtacagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgctggggtggtttcggtgctgttgatcattggggtcaaggtactctggtgaccgtctcctca

SEQ ID NO: 618 - protein, 247 aa, Artificial Sequence
  Description of Artificial Sequence: Synthetic polypeptide
QSVVTQPPSVSVAPGKTARITCGGNNIGSKSVHWYQQKPGQAPVLVIYYDSDRPSGIPERFSGSNSGNTATLTISRVEAGDEADYYCQVWDSSSDVVFGGGTKLTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARWGGFGAVDHWGQGTLVTVSS

SEQ ID NO: 619 - DNA, 735 bp, Artificial Sequence
  Description of Artificial Sequence: Synthetic polynucleotide
tcttctgagctgactcaggaccctgctgtgtctgtggccttgggacagacagtcaagatcacgtgccaaggagacagcctcacagactaccatgcaacctggtaccagcagaagccaggacaggcccctgtcgctgtcatctatgctacaaacaaccggcccactgggatcccagaccgattctctggttccagttccggaaacacagcttctttgaccatcactggggctcaggcggaagatgaggctgactattactgtaattcccgggacagcggcacggacgaagtgttattcggcggagggaccaagctgaccgtcctaggttctagaggtggtggtggtagcggcggcggcggctctggtggtggtggatccctcgagatggccgaggtgcagctggtggagactgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggccgtgtattactgtgcgcgcggtcagggttacgattactggggtcaaggtactctggtgaccgtctcctca

SEQ ID NO: 620 - protein, 245 aa, Artificial Sequence
  Description of Artificial Sequence: Synthetic polypeptide
SSELTQDPAVSVALGQTVKITCQGDSLTDYHATWYQQKPGQAPVAVIYATNNRPTGIPDRFSGSSSGNTASLTITGAQAEDEADYYCNSRDSGTDEVLFGGGTKLTVLGSRGGGGSGGGGSGGGGSLEMAEVQLVETGGGLVKPGGSLRLSCAASGFTFSSYSMNWVRQAPGKGLEWVSSISSSSSYIYYADSVKGRFTISRDNAKNSLYLQMNSLRAEDTAVYYCARGQGYDYWGQGTLVTVSS

SEQ ID NO: 621 - DNA, 735 bp, Artificial Sequence
  Description of Artificial Sequence: Synthetic polynucleotide
tcctatgtgctgactcagccaccctcggtgtcagtggccccaggaaagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgagcatcagcagggtcgaagccggggatgaggccgactattactgtcaggtgtgggatagtagtagtgatcatactgtcttcggaactgggaccaaggtcaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgctactacccgggtatggatatgtggggtcaaggtactctggtgaccgtctcctca

SEQ ID NO: 622 - protein, 245 aa, Artificial Sequence
  Description of Artificial Sequence: Synthetic polypeptide
SYVLTQPPSVSVAPGKTARITCGGNNIGSKSVHWYQQKPGQAPVLVVYDDSDRPSGIPERFSGSNSGNTATLSISRVEAGDEADYYCQVWDSSSDHTVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARYYPGMDMWGQGTLVTVSS

SEQ ID NO: 623 - DNA, 741 bp, Artificial Sequence
  Description of Artificial Sequence: Synthetic polynucleotide
caggctgtgctgactcagccgccctcaacgtctgggacccccgggcagagggtcaccatctcttgttctggaagcagctccaacatcgggagaaatggtgtaaactggtaccagcagctcccaggagcggcccccaaagtcctcatctataatgataatcagcgaccctcaggggtccctgaccgagtctctggctcccagtctggctcctcaggcaccctggccatcgatgggcttcggtctgaggatgaggctgattattactgtgcggcatgggatgacagcctgcatggtgtggtattcggcggagggaccaagctgaccgtcctaggttctagaggtggtggtggtagcggcggcggcggctctggtggtggtggatccctcgagatggcccaggtccagctggtacagtctggggctgaggtgaagaagcctggggcctcagtgaaggtctcctgcaaggtttccggatacaccctcaatgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgcggtggttacggtgattcttggggtcaaggtactctggtgaccgtctcctca

SEQ ID NO: 624 - protein, 247 aa, Artificial Sequence
  Description of Artificial Sequence: Synthetic polypeptide
QAVLTQPPSTSGTPGQRVTISCSGSSSNIGRNGVNWYQQLPGAAPKVLIYNDNQRPSGVPDRVSGSQSGSSGTLAIDGLRSEDEADYYCAAWDDSLHGVVFGGGTKLTVLGSRGGGGSGGGGSGGGGSLEMAQVQLVQSGAEVKKPGASVKVSCKVSGYTLNELSMHWVRQAPGKGLEWMGGFDPEDGETIYAQKFQGRVTMTEDTSTDTAYMELSSLRSEDTAVYYCARGGYGDSWGQGTLVTVSS

SEQ ID NO: 625 - DNA, 795 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattcttgggtgttcggcggagggaccaagctgaccgtcctaggttctagaggtggtggtggtagcggcggcggcggctctggtggtggtggatccctcgagatggcccaggtgcagctggtgcaatctggggctgaggtgaagaggcctgggtcctcggtgaaggtctcctgcacggcttctggaggcaccttcagcagcgatgctatcagctgggtgcgacaggcccctggacaagggcttgagtggatgggaggaatcatccctatgtttggtacagcaaactacgcacagaagttccagggcagagtcacgattaccgcggacgaatccacgagcacagcctacatggagctgagcagcctgagatctgaggacacggccgtgtattactgtgcgcgcgaaggttactactacccgtctgcttacctgggttctgttctgaacgacatctcttctgtttacgatgaatggggtcaaggtactctggtgaccgtctcctca

SEQ ID NO: 626 - protein, 265 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSWVFGGGTKLTVLGSRGGGGSGGGGSGGGGSLEMAQVQLVQSGAEVKRPGSSVKVSCTASGGTFSSDAISWVRQAPGQGLEWMGGIIPMFGTANYAQKFQGRVTITADESTSTAYMELSSLRSEDTAVYYCAREGYYYPSAYLGSVLNDISSVYDEWGQGTLVTVSS

SEQ ID NO: 627 - DNA, 747 bp, Artificial Sequence
  Description of Artificial Sequence: Synthetic polynucleotide
cagtctgtcgtgacgcagccgccctcagtgtctgcggccccaggacagaaggtcaccatctcctgctctggaagcacctccaacattggaaataatgatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcgtgagtgcttcttgggtcttcggcagagggaccaagctgaccgtcctaggttctagaggtggtggtggtagcggcggcggcggctctggtggtggtggatccctcgagatggcccaggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatccacagaagctccagggcagagtcaccatgaccacagacccatccacgagcacagcctacatggagctgaggagcctgagatctgacgacacggccgtgtattactgtgcgcgctctatgacttctttcgattactggggtcaaggtactctggtgaccgtctcctca

SEQ ID NO: 628 - protein, 249 aa, Artificial Sequence
  Description of Artificial Sequence: Synthetic polypeptide
QSVVTQPPSVSAAPGQKVTISCSGSTSNIGNNDVSWYQQLPGTAPKLLIYDNNKRPSGIPDRFSGSKSGTSATLGITGLQTGDEADYYCGTWDSSVSASWVFGRGTKLTVLGSRGGGGSGGGGSGGGGSLEMAQVQLVQSGAEVKKPGASVKVSCKASGYTFTSYGISWVRQAPGQGLEWMGWISAYNGNTNYPQKLQGRVTMTTDPSTSTAYMELRSLRSDDTAVYYCARSMTSFDYWGQGTLVTVSS

SEQ ID NO: 629 - DNA, 747 bp, Artificial Sequence
  Description of Artificial Sequence: Synthetic polynucleotide
cagtctgtgttgacgcagccgccctcagtgtctgcggccccaggacagaaggtcaccatctcctgctctggaagcaactccaacattgggaataattatgtatcctggtatcagcaactcccagggacagcccccaaactcctcatttatgacaataataagcgaccctcagggattcctgaccgattctctggctccaggtctggcacgtcagccaccctgggcatcaccggactccagactggggacgaggccgattattactgcggaacatggaataccactgtgactcctggctatgtcttcggaactgggaccaaggtcaccgtcctaggttctagaggtggtggtggtagcggcggcggcggctctggtggtggtggatccctcgagatggccgaagtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacaccgccatgtattactgtgcgcgctctgtttacgacctggatacttggggtcaaggtactctggtgaccgtctcctca

SEQ ID NO: 630 - protein, 249 aa, Artificial Sequence
  Description of Artificial Sequence: Synthetic polypeptide
QSVLTQPPSVSAAPGQKVTISCSGSNSNIGNNYVSWYQQLPGTAPKLLIYDNNKRPSGIPDRFSGSRSGTSATLGITGLQTGDEADYYCGTWNTTVTPGYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAMYYCARSVYDLDTWGQGTLVTVSS

SEQ ID NO: 631 - DNA, 756 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgggggccccttatgtcttcggaactgggaccaaggtcaccgtcctaggttctagaggtggtggtggtagcggcggcggcggctctggtggtggtggatccctcgagatggccgaggtgcagctggtgcagtcttggggaggctcggaacagcctggcaggtccctgagactctcctgtgcagcctctggattcacctttgatgattatgccatgcactgggtccggcaagctccagggaagggcctggagtgggtctcaggtattagttggaatagcggtagcataggctatgcggactctgtgaagggccgattcaccatctccagagacaacgccaagaattccctgtatctgcaaatgaacagtctgagagctgaggacaccgccatgtattactgtgcgcgctaccgtcaggttggttctgcttacgattcttggggtcaaggtactctggtgaccgtctcctca

SEQ ID NO: 632 - protein, 252 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLGAPYVFGTGTKVTVLGSRGGGGSGGGGSGGGGSLEMAEVQLVQSWGGSEQPGRSLRLSCAASGFTFDDYAMHWVRQAPGKGLEWVSGISWNSGSIGYADSVKGRFTISRDNAKNSLYLQMNSLRAEDTAMYYCARYRQVGSAYDSWGQGTLVTVSS

SEQ ID NO: 633 - DNA, 747 bp, Artificial Sequence
  Description of Artificial Sequence: Synthetic polynucleotide
ctgcctgtgctgactcagccaccctcggtgtcagtggccccaggaaagacggccaggattacctgtgggggaaacaacattggaagtaaaagtgtgcactggtatcagcagaagccaggccaggcccctgtgctggtcgtctatgctgatagcgaccggccctcagggatccctgagcgattctctggctccaactctgggaacacggccaccctgaccatcagcagggtcgaagccggggatgaggccgactattactgtcaggtgtgggatagtagtagttatcataattatgtcttcggaactgggaccaaggtcaccgtcctaggttctagaggtggtggtggtagcggcggcggcggctctggtggtggtggatccctcgagatggccgaggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgaggacaccgccatgtattactgtgcgcgctactggggtttcggtgtttctgatcgttggggtcaaggtactctggtgaccgtctcctca

SEQ ID NO: 634 - protein, 249 aa, Artificial Sequence
  Description of Artificial Sequence: Synthetic polypeptide
LPVLTQPPSVSVAPGKTARITCGGNNIGSKSVHWYQQKPGQAPVLVVYADSDRPSGIPERFSGSNSGNTATLTISRVEAGDEADYYCQVWDSSSYHNYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELSSLRSEDTAMYYCARYWGFGVSDRWGQGTLVTVSS

SEQ ID NO: 635 - DNA, 750 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccccgatcggttctctggctccatcgacagctcctccaactctgcctccctcaccatctctggactgaagactgaggacgaggctgactactactgtcagtcttatgacagcagcaatctttgggtgttcggcggagggaccaagctgaccgtcctaggttctagaggtggtggtggtagcggcggcggcggctctggtggtggtggatccctcgagatggcccagatgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgctacaactactactactacgattcttggggtcaaggtactctggtgaccgtctcctca

SEQ ID NO: 636 - protein, 250 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNLWVFGGGTKLTVLGSRGGGGSGGGGSGGGGSLEMAQMQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYYYDSWGQGTLVTVSS

SEQ ID NO: 637 - DNA, 741 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaacgttctagaggtggtggtggtagcggcggcggcggctctggtggtggtggatccctcgagatggccgaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacaccgccatgtattactgtgcgcgctactggggttacgactcttacgatgaatggggtcaaggtactctggtgaccgtctcctca

SEQ ID NO: 638 - protein, 247 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKRSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAMYYCARYWGYDSYDEWGQGTLVTVSS

SEQ ID NO: 639 - DNA, 747 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgcaacaaccattactacaacgattactggggtcaaggtactctggtgaccgtctcctca

SEQ ID NO: 640 - protein, 249 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARNNHYYNDYWGQGTLVTVSS

SEQ ID NO: 641 - DNA, 777 bp, Artificial Sequence
  Description of Artificial Sequence: Synthetic polynucleotide
cagtctgtgttgacgcagccgccctcagtgtctggggccccagggcagggggtcaccatcccctgcactgggagcagctccaacatcggggcaggttatgatgtacactggtaccagcagcttccagggacagcccccaaactcctcatctatggtaacaacaatcggccctcaggggtccctgaccgcttctctggctccaggtctggctcctcagcctccctggccatcactgggctccaggctgaggatgaggctgattattactgccagtcctatgacagcagcctgagtgatgtggtattcggcggagggaccaaggtcaccgtcctaggttctagaggtggtggtggtagcggcggcggcggctctggtggtggtggatccctcgagatggccgaggtccagctggtgcagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcgcgctactggtcttactctttcgactacctgtacatgccggaaggtaacgattggtggggtcaaggtactctggtgaccgtctcctca

SEQ ID NO: 642 - protein, 259 aa, Artificial Sequence
  Description of Artificial Sequence: Synthetic polypeptide
QSVLTQPPSVSGAPGQGVTIPCTGSSSNIGAGYDVHWYQQLPGTAPKLLIYGNNNRPSGVPDRFSGSRSGSSASLAITGLQAEDEADYYCQSYDSSLSDVVFGGGTKVTVLGSRGGGGSGGGGSGGGGSLEMAEVQLVQSGAEVKKPGATVKISCKVSGYTFTDYYMHWVQQAPGKGLEWMGLVDPEDGETIYAEKFQGRVTITADTSTDTAYMELSSLRSEDTAVYYCARYWSYSFDYLYMPEGNDWWGQGTLVTVSS

SEQ ID NO: 643 - DNA, 753 bp, Artificial Sequence
  Description of Artificial Sequence: Synthetic polynucleotide
cagtctgtgttgactcagccacccgcagcgtctgggacccccggacagagagtcaccatctcttgttctgggggcgtctccaacatcgggagtggtgctctaaattggtaccagcaactcccaggaacggcccccaaactcctcatctatagttacaatcagcggccctcaggggtctctgaccgattctctggctccaggtctgccacctcagcctccctggccatcagtgggctccagtctgaggatgaggctgattattactgtgcaacctgggatgatagtgtgaatggttgggtgttcggcggagggaccaagctgaccgtcctaggttctagaggtggtggtggtagcggcggcggcggctctggtggtggtggatccctcgagatggcccaggtccagctggtacagtctggagctgaggtgaagaagcctggggattcagtgaaggtctcctgcaagccttctggttacaattttctcaactatggtatcaactgggtgcgacaggcccctggacaagggcttgagtggatgggatggattagcacttacaccggtaacacaaactatgcacagaagctgcagggcagagtcaccttcaccacagacacatccacgagcacagcctacatggagatgaggagcctgagatctgacgacacggccgtgtattactgtgcgcgcgacctgtactactacgaaggtgttgattactggggtcaaggtactctggtgaccgtctcctca

SEQ ID NO: 644 - protein, 251 aa, Artificial Sequence
  Description of Artificial Sequence: Synthetic polypeptide
QSVLTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAQVQLVQSGAEVKKPGDSVKVSCKPSGYNFLNYGINWVRQAPGQGLEWMGWISTYTGNTNYAQKLQGRVTFTTDTSTSTAYMEMRSLRSDDTAVYYCARDLYYYEGVDYWGQGTLVTVSS

SEQ ID NO: 645 - DNA, 747 bp, Artificial Sequence
  Description of Artificial Sequence: Synthetic polynucleotide
caggctgtgctgactcagccaccctcagtgtcagtggccccaggaaagacggccagggttacctgtgggggaaacaacattggaagtgaaagtgtgcactggtaccagcagaagccaggccaggcccctgtgttggtcatctattatgataccgaccggccctcagggatccctgagcgattctctggctcccactctgggaccacggccaccctgaccatcagcagggtcgaagccggggatgaggccgactattactgtcaggtgtgggatagtagtagggatcatgtggtattcggcggagggaccaagctgaccgtcctaggttctagaggtggtggtggtagcggcggcggcggctctggtggtggtggatccctcgagatggcccaggtgcagctggtgcagtctgggggaggcgtggtccagcctgggaggtccctgagactctcctgtgcggcctctggattcaccttcagtagctatgctatgcactgggtccgccaggctccaggcaagggactggagtgggtggcagttatatcatatgatggaagcaataaatactacgcagactccgtgaagggcctattcaccatctccagagacaattccaagaacacgctgtatctgcaaatgaacagcctgagagctgaggacacggccgtgtattactgtgcgcgctcttacttcacttctggtttctacgattactggggtcaaggtactctggtgaccgtctcctca

SEQ ID NO: 646 - protein, 249 aa, Artificial Sequence
  Description of Artificial Sequence: Synthetic polypeptide
QAVLTQPPSVSVAPGKTARVTCGGNNIGSESVHWYQQKPGQAPVLVIYYDTDRPSGIPERFSGSHSGTTATLTISRVEAGDEADYYCQVWDSSRDHVVFGGGTKLTVLGSRGGGGSGGGGSGGGGSLEMAQVQLVQSGGGVVQPGRSLRLSCAASGFTFSSYAMHWVRQAPGKGLEWVAVISYDGSNKYYADSVKGLFTISRDNSKNTLYLQMNSLRAEDTAVYYCARSYFTSGFYDYWGQGTLVTVSS

SEQ ID NO: 647 - DNA, 750 bp, Artificial Sequence
  Description of Artificial Sequence: Synthetic polynucleotide
cagtctgtcgtgacgcagccgccctcagtgtctggggccccagggcagagggtcaccatctcctgcactgggagcagttccaacatcggggcaggttatgatgtaaattggtatcagcagtttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggctcttatgtcttcggaactgggaccaaggtcaccgtcctaggttctagaggtggtggtggtagcggcggcggcggctctggtggtggtggatccctcgagatggcccagatgcagctggtgcagtctggggctgaggtgaagaagcctggggcctcagtgaaggtctcctgcaaggcttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgcatgtcttctatgtactacgattggggtcaaggtactctggtgaccgtctcctca

SEQ ID NO: 648 - protein, 250 aa, Artificial Sequence
  Description of Artificial Sequence: Synthetic polypeptide
QSVVTQPPSVSGAPGQRVTISCTGSSSNIGAGYDVNWYQQFPGTAPKLLIYGNSNRPSGVPDRFSGSKSGTSASLAITGLQAEDEADYYCQSYDSSLSGSYVFGTGTKVTVLGSRGGGGSGGGGSGGGGSLEMAQMQLVQSGAEVKKPGASVKVSCKASGYTLTELSMHWVRQAPGKGLEWMGGFDPEDGETIYAQKFQGRVTMTEDTSTDTAYMELSSLRSEDTAVYYCARMSSMYYDWGQGTLVTVSS

SEQ ID NO: 649 - DNA, 732 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgattatgtcttcggaactgggaccaaggtcaccgtcctaggttctagaggtggtggtggtagcggcggcggcggctctggtggtggtggatccctcgagatggccgaggtgcagctggtggagactgggggaggcttggtcaagcctggagggtccctgagactctcctgtgcagcctctggattcaccgtcagtgactactacatgagctggatccgccaggctccagggaagggcctggagtggatttcatacattagtggtagtggtaatagcatatactacgcagactctgtgaagggccgattcaccatctccagggacaacgccaagaactcactggatctgcaaatgaccagcctgagagccgaggacacggccgtatattactgtgcgcgctctactaaattcgattactggggtcaaggtactctggtgaccgtctcctca

SEQ ID NO: 650 - protein, 244 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDYVFGTGTKVTVLGSRGGGGSGGGGSGGGGSLEMAEVQLVETGGGLVKPGGSLRLSCAASGFTVSDYYMSWIRQAPGKGLEWISYISGSGNSIYYADSVKGRFTISRDNAKNSLDLQMTSLRAEDTAVYYCARSTKFDYWGQGTLVTVSS

SEQ ID NO: 651 - DNA, 753 bp, Artificial Sequence
  Description of Artificial Sequence: Synthetic polynucleotide
ctgcctgtgctgactcagccaccctcagcgtctgggacccccgggcagagggtcaccatctcttgttctggaagcagctccaacgtcggaagttacactgtaaactggtaccggcaactcccaggaacggcccccacactcctcatctataataataatcagcggccctcaggggtccctgaccgattctctgactccaagtctggcacctcggcctccctgaccattagtgggctccagcctgaggatgaggctgattattattgtgcagcatgggatgacaggctgggtggttatgtcttcggaactgggaccaaggtcaccgtcctaggttctagaggtggtggtggtagcggcggcggcggctctggtggtggtggatccctcgagatggccgaggtgcagctggtgcagtctggagcagaggtgaaaaagccgggggagtctctgaagatctcctgtaagggttctggatacagctttaccaactactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctacagtggagcagcctgaaggcctcggacaccgccatgtattactgtgcgcgctctactggttcttctcatatgtctgatgaatggggtcaaggtactctggtgaccgtctcctca

SEQ ID NO: 652 - protein, 251 aa, Artificial Sequence
  Description of Artificial Sequence: Synthetic polypeptide
LPVLTQPPSASGTPGQRVTISCSGSSSNVGSYTVNWYRQLPGTAPTLLIYNNNQRPSGVPDRFSDSKSGTSASLTISGLQPEDEADYYCAAWDDRLGGYVFGTGTKVTVLGSRGGGGSGGGGSGGGGSLEMAEVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARSTGSSHMSDEWGQGTLVTVSS

SEQ ID NO: 653 - DNA, 744 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcattgggtgttcggcggagggaccaagctgaccgtcctaggttctagaggtggtggtggtagcggcggcggcggctctggtggtggtggatccctcgagatggcccaagtgcagctacagcagtggggcgcaggactgttgaagccttcggagaccctgtccctcacctgcgctgtctatggtgggtccttcagtggttactactggagctggatccgccagcccccagggaaggggctggagtggattggggagatcactcatagtggaaggtccaactacaacccgtccctcaagagtcgagtcaccatatcagtagacacgtccaagaaccagttctccctgaagctgagctctgtgaccgccgcggacacggccgtgtattactgtgcgcgctcttctatcatgtctgattactggggtcaaggtactctggtgaccgtctcctca

SEQ ID NO: 654 - protein, 248 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVLGSRGGGGSGGGGSGGGGSLEMAQVQLQQWGAGLLKPSETLSLTCAVYGGSFSGYYWSWIRQPPGKGLEWIGEITHSGRSNYNPSLKSRVTISVDTSKNQFSLKLSSVTAADTAVYYCARSSIMSDYWGQGTLVTVSS

SEQ ID NO: 655 - DNA, 753 bp, Artificial Sequence
  Description of Artificial Sequence: Synthetic polynucleotide
cagtctgtgttgacgcagccgccctcagtgtctggggccccagggcagagggtcaccatctcctgcactgggagcacctccaacatcggggcaggttatgatgtacactggtaccagcagcttccaggaacagcccccaaactcctcatcaacaataacaggaatcggccctcaggggtccctgaccgattctctggctccaagtctggcacgtcagccaccctgggcatcaccggactccagactggggacgaggccgattattactgcggaacatgggatggcagcctgactggtgcagtgttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcatgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgcggttctgctctggaccattacgatcgttggggtcaaggtactctggtgaccgtctcctca

SEQ ID NO: 656 - protein, 251 aa, Artificial Sequence
  Description of Artificial Sequence: Synthetic polypeptide
QSVLTQPPSVSGAPGQRVTISCTGSTSNIGAGYDVHWYQQLPGTAPKLLINNNRNRPSGVPDRFSGSKSGTSATLGITGLQTGDEADYYCGTWDGSLTGAVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGSALDHYDRWGQGTLVTVSS

SEQ ID NO: 657 - DNA, 747 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaccaattgggtgttcggcggagggaccaagctgaccgtcctaggttctagaggtggtggtggtagcggcggcggcggctctggtggtggtggatccctcgagatggcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgctacaactactacttcaacgattactggggtcaaggtactctggtgaccgtctcctca

SEQ ID NO: 658 - protein, 249 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSTNWVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYFNDYWGQGTLVTVSS

SEQ ID NO: 659 - DNA, 744 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggttctagaggtggtggtggtagcggcggcggcggctctggtggtggtggatccctcgagatggcccagatgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacactgccgtgtattactgtgcgcgctctatgttcggtgctcatgattcttggggtcaaggtactctggtgaccgtctcctca

SEQ ID NO: 660 - protein, 248 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPYVFGTGTKVTVLGSRGGGGSGGGGSGGGGSLEMAQMQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSMFGAHDSWGQGTLVTVSS

SEQ ID NO: 661 - DNA, 753 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacatcggggcaggttttgatgtacactggtaccagctacttccaggaacagcccccaaactcctcatctatgctaacagcaatcggccctcaggggtccctgaccgattctctggctccaagtctggcacctcagcctccctggccatcactgggctcctggctgaggatgaggctgattattactgccagtcctatgacagcagcctgagtggtgtggtattcggcggagggaccaagctgaccgtcctaggttctagaggtggtggtggtagcggcggcggcggctctggtggtggtggatccctcgagatggcccaggtgcagctggtgcaatctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgcggtgcttctttcgaccgtcatgataactggggtcaaggtactctggtgaccgtctcctca

SEQ ID NO: 662 - protein, 251 aa, Artificial Sequence
  Description of Artificial Sequence: Synthetic polypeptide
QSVLTQPPSVSGAPGQRVTISCTGSSSNIGAGFDVHWYQLLPGTAPKLLIYANSNRPSGVPDRFSGSKSGTSASLAITGLLAEDEADYYCQSYDSSLSGVVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGASFDRHDNWGQGTLVTVSS

SEQ ID NO: 663 - DNA, 747 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgctctaactactactacaacgattactggggtcaaggtactctggtgaccgtctcctca

SEQ ID NO: 664 - protein, 249 aa, Artificial Sequence
  Description of Artificial Sequence: Synthetic polypeptide
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSNYYYNDYWGQGTLVTVSS

SEQ ID NO: 665 - DNA, 747 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtcctaggttctagaggtggtggtggtagcggcggcggcggctctggtggtggtggatccctcgagatggcccaggtgcagctggtgcagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgctactctggtgtttactacgattggggtcaaggtactctggtgaccgtctcctca

SEQ ID NO: 666 - protein, 249 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLGSRGGGGSGGGGSGGGGSLEMAQVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCARYSGVYYDWGQGTLVTVSS

SEQ ID NO: 667 - DNA, 747 bp, Artificial Sequence
  Description of Artificial Sequence: Synthetic polynucleotide
aattttatgctgactcagccccactctgtgtcggggtctccggggaagacggtaaccatctcctgcaccggcagcagtggcagcattgccgacaactttgtgcagtggtaccagcagcgcccgggcggtgtccccaccactgtgatctttaatgatgacgaaagaccctctggcgtccctgatcggttctctggctccatcgacacctcctccaattctgcctccctcaccatctctggactgaagactgaggacgaggctgactactactgtcagtcttatgataataataatcgaggggtgttcggcggagggaccaagctgaccgtcctaggttctagaggtggtggtggtagcggcggcggcggctctggtggtggtggatccctcgagatggcccaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatgaaccctaacagtggtaacacaggctatgcacagaagttccagggcagagtcaccatgaccaggaacacctccataagcacagcctacatggagctgagcaacctgagatctgaggacacggccgtgtattactgtgcgcgctactactcttacggttacgattggggtcaaggtactctggtgaccgtctcctca

SEQ ID NO: 668 - protein, 249 aa, Artificial Sequence
  Description of Artificial Sequence: Synthetic polypeptide
NFMLTQPHSVSGSPGKTVTISCTGSSGSIADNFVQWYQQRPGGVPTTVIFNDDERPSGVPDRFSGSIDTSSNSASLTISGLKTEDEADYYCQSYDNNNRGVFGGGTKLTVLGSRGGGGSGGGGSGGGGSLEMAQVQLVQSGAEVKKPGSSVKVSCKASGGTFSSYAISWVRQAPGQGLEWMGWMNPNSGNTGYAQKFQGRVTMTRNTSISTAYMELSNLRSEDTAVYYCARYYSYGYDWGQGTLVTVSS

SEQ ID NO: 669 - DNA, 765 bp, Artificial Sequence
  Description of Artificial Sequence: Synthetic polynucleotide
cagtctgtcgtgacgcagccgccctcagtgtctggggccccagggcagacggtcaccatctcctgcactgggggcagctccaacatcgggacaggttattttgtaaattggtaccagcaggttccaggaaaagcccccaaactcctcatcctgggtaacaataatcggccctcgggggtccctgaccgactctccggctccacgtccggcacctcagcctccctggccatcactgggctccaggctgaggatgagggtacttattactgccagtcctatgacagcagcctgagtggttatgtcttcggaactgggaccaaggtcaccgtcctaggttctagaggtggtggtggtagcggcggcggcggctctggtggtggtggatccctcgagatggcccaggtacagctgcagcagtcaggtccaggactggtgaagccctcgcagaccctctcactcacctgtggcatctccggggacagtgtctctaccaacagtgttgcttggcactggatcaggcagtccccatcgagaggccttgagtggctgggaaggacatactacaggtccaagtggtctaatgactatggagtatctgtgaaaagtcgaatcaccatcatcccagacacatccaagaaccagttctccctgcagctgaactctgtgactcccgaggacacggctgtgtattactgtgcgcgctcttcttcttggtaccagatcttcgattactggggtcaaggtactctggtgaccgtctcctca

SEQ ID NO: 670 - protein, 255 aa, Artificial Sequence
  Description of Artificial Sequence: Synthetic polypeptide
QSVVTQPPSVSGAPGQTVTISCTGGSSNIGTGYFVNWYQQVPGKAPKLLILGNNNRPSGVPDRLSGSTSGTSASLAITGLQAEDEGTYYCQSYDSSLSGYVFGTGTKVTVLGSRGGGGSGGGGSGGGGSLEMAQVQLQQSGPGLVKPSQTLSLTCGISGDSVSTNSVAWHWIRQSPSRGLEWLGRTYYRSKWSNDYGVSVKSRITIIPDTSKNQFSLQLNSVTPEDTAVYYCARSSSWYQIFDYWGQGTLVTVSS

SEQ ID NO: 671 - DNA, 762 bp, Artificial Sequence
  Description of Artificial Sequence: Synthetic polynucleotide
aattttatgctgactcagccccactctgtgtcggagtctccggggaagacggtaaccatctcctgcaccggcagcagcgacagcatagccaacaactatgttcagtggtaccagcagcgcccgggcagtgcccccaccaatgtgatctacgaagatgtccaaagaccctctggggtccctgatcggttctctgggtccatcgacagctcctccaactctgcctccctcaccatctctggactgaagactgaggacgaggctgtctactattgtcagtcttatcatagcgacaatcgttgggtgttcggcggcgggaccaagctgaccgtcctaggttctagaggtggtggtggtagcggcggcggcggctctggtggtggtggatccctcgagatggcccaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgcgctctggtgcttactgggactactctgtttacgatgaatggggtcaaggtactctggtgaccgtctcctca

SEQ ID NO: 672 - protein, 254 aa, Artificial Sequence
  Description of Artificial Sequence: Synthetic polypeptide
NFMLTQPHSVSESPGKTVTISCTGSSDSIANNYVQWYQQRPGSAPTNVIYEDVQRPSGVPDRFSGSIDSSSNSASLTISGLKTEDEAVYYCQSYHSDNRWVFGGGTKLTVLGSRGGGGSGGGGSGGGGSLEMAQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARSGAYWDYSVYDEWGQGTLVTVSS

SEQ ID NO: 673 - DNA, 744 bp, Artificial Sequence
  Description of Artificial Sequence: Synthetic polynucleotide
cagtctgtgttgactcagccaccctcagtgtccgtgtccccaggacagacagccaccatcgcctgttctggacataaattgggggataaatatgcttcctggtatcagcagaagtcgggccagtcccctgtgttgatcatctatcaggataataagcggccctcagggattcctgagcgattctctggctccaactctgggaacacagccactctgaccatcagcgggacccaggctctggatgaggctgactattattgtcaggcgtgggacagtagtacttatgtggcattcggcggagggaccaagctgaccgtcctaggttctagaggtggtggtggtagcggcggcggcggctctggtggtggtggatccctcgagatggcccaggtgcagctgcaggagtccggcccaggactggtgaagccttcggagaccctgtccctcacctgcgttgtctctggtggctccatcagcagtagtaactggtggagctgggtccgccagcccccagggaaggggctggagtggattggggaaatctatcatagtgggagccccaactacaacccatccctcaagagtcgagtcaccatatcagtagacaagtccaagaaccagttctccctgaagctgagctctgtgaccgccgcggacacggccgtgtattactgtgcgcgcatgactactcatactttcggttacgatgcttggggtcaaggtactctggtgaccgtctcctca

SEQ ID NO: 674 - protein, 248 aa, Artificial Sequence
  Description of Artificial Sequence: Synthetic polypeptide
QSVLTQPPSVSVSPGQTATIACSGHKLGDKYASWYQQKSGQSPVLIIYQDNKRPSGIPERFSGSNSGNTATLTISGTQALDEADYYCQAWDSSTYVAFGGGTKLTVLGSRGGGGSGGGGSGGGGSLEMAQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARMTTHTFGYDAWGQGTLVTVSS

SEQ ID NO: 675 - DNA, 735 bp, Artificial Sequence
  Description of Artificial Sequence: Synthetic polynucleotide
cagcctgtgctgactcagccaccctcagtgtcagtggccccaggaaagacggccacgattacttgtgggggaaacaacattggaagtgaaagtgtgcactggtaccaccagaagccaggccaggcccctgtgttggtcatctatgatgatgccggccggccctcagggatccctgagcgattcactggctccaactctgggaacacggccaccctgaccatcagcagggtcgaagccggggatgaggccgactattactgtcaggtgtgggacagaaatagtgctcagtttgtcttcggacctgggaccaaggtcaccgtcctaggttctagaggtggtggtggtagcggcggcggcggctctggtggtggtggatccctcgagatggccgaggtccagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgcggtgttcatctggattggtggggtcaaggtactctggtgaccgtctcctca

SEQ ID NO: 676 - protein, 245 aa, Artificial Sequence
  Description of Artificial Sequence: Synthetic polypeptide
QPVLTQPPSVSVAPGKTATITCGGNNIGSESVHWYHQKPGQAPVLVIYDDAGRPSGIPERFTGSNSGNTATLTISRVEAGDEADYYCQVWDRNSAQFVFGPGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGVHLDWWGQGTLVTVSS

SEQ ID NO: 677 - DNA, 771 bp, Artificial Sequence
  Description of Artificial Sequence: Synthetic polynucleotide
cagtctgtcgtgacgcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggttatgtcttcggaactgggaccaagctgaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgcctgtacgaaggtggttaccatggttggggttcttggctgtcttctgattcttggggtcaaggtactctggtgaccgtctcctca

SEQ ID NO: 678 - protein, 257 aa, Artificial Sequence
  Description of Artificial Sequence: Synthetic polypeptide
QSVVTQPPSASGTPGQRVTISCSGSSSNIGSNYVYWYQQLPGTAPKLLIYSNNQRPSGVPDRFSGSKSGTSASLAISGLRSEDEADYYCAAWDDSLSGYVFGTGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLYEGGYHGWGSWLSSDSWGQGTLVTVSS

SEQ ID NO: 679 - DNA, 750 bp, Artificial Sequence
  Description of Artificial Sequence: Synthetic polynucleotide
cagtctgtgttgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttattgggtgttcggcggagggaccaagctgaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgcgcgaaggggcatttgatgcttttgatatctggggccaagggacaatggtcaccgtctcttca

SEQ ID NO: 680 - protein, 250 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYWVFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGAFDAFDIWGQGTMVTVSS

SEQ ID NO: 681 - DNA, 756 bp, Artificial Sequence
  Description of Artificial Sequence: Synthetic polynucleotide
tcctatgagctgactcagccaccctcagcgtctgggacccccgggcagagggtcaccatctcttgttctggaagcagctccaacatcggaagtaattatgtatactggtaccagcagctcccaggaacggcccccaaactcttcatctataggaataatcagcggccctcaggggtccctgaccgattctctggctccaagtctggcacctcagcctccctggccatcagtgggctccggtccgaggatgaggctgattattactgtgcagcatgggatgacagcctgagtggttatctcttcggaactgggaccaaggtcaccgtcctaggttctagaggtggtggtggtagcggcggcggcggctctggtggtggtggatccctcgagatggccgaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaatggcgactccaactactactacggtatggacgtctggggccaagggaccacggtcaccgtctcctca

SEQ ID NO: 682 - protein, 252 aa, Artificial Sequence
  Description of Artificial Sequence: Synthetic polypeptide
SYELTQPPSASGTPGQRVTISCSGSSSNIGSNYVYWYQQLPGTAPKLFIYRNNQRPSGVPDRFSGSKSGTSASLAISGLRSEDEADYYCAAWDDSLSGYLFGTGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCANGDSNYYYGMDVWGQGTTVTVSS

SEQ ID NO: 683 - DNA, 768 bp, Artificial Sequence
  Description of Artificial Sequence: Synthetic polynucleotide
cagtctgccctgactcagcctgcctccgtgtccgggtctcctggacagtcgatcaccatctcctgcactggaaccagcagtgacattggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcatctcatatacacgcacctggaacccctatgtcttcgggagtgggaccaaggtcaccgtcctaggttctagaggtggtggtggtagcggcggcggcggctctggtggtggtggatccctcgagatggccgaggtgcagctggtgcagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaagatcgggcagcagctggctactactactacggtatggacgtctggggccaagggaccacggtcaccgtctcctca

SEQ ID NO: 684 - protein, 256 aa, Artificial Sequence
  Description of Artificial Sequence: Synthetic polypeptide
QSALTQPASVSGSPGQSITISCTGTSSDIGGYNYVSWYQQHPGKAPKLMIYDVSNRPSGVSNRFSGSKSGNTASLTISGLQAEDEADYYCISYTRTWNPYVFGSGTKVTVLGSRGGGGSGGGGSGGGGSLEMAEVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDRAAAGYYYYGMDVWGQGTTVTVSS

SEQ ID NO: 685 - DNA, 750 bp, Artificial Sequence
  Description of Artificial Sequence: Synthetic polynucleotide
ctgcctgtgctgactcagccaccctcagtgtccgtgtccccaggacagacagccatcatcacctgctctggagataaattgggggaaaaatatgtttcctggtatcagcagaagccaggccagtcccctgtactggtcatcgatcaagataccaggaggccctcagggatccctgagcgattctctggctccaactctgggaccacagccactctgaccatcagcgggacccaggctatggatgaggctgactattactgtcaggcgtgggacaggggtgtggtattcggcggagggaccaagctgaccgtcctaggttctagaggtggtggtggtagcggcggcggcggctctggtggtggtggatccctcgagatggccgaggtgcagctggtggagtctgggggagacttggtacagcctggcaggtccctgagactctcctgtgcagcctctggattcacctttaatgattatgccatgcactgggtccggcaagctccagggaagggcctggagtgggtctcaggtattagttggagtggtaataacataggctatgcggactctgtgaagggccgattcaccatctccagagacaacgccaagaactccctgtatctgcaaatgaacagtctgagagctgaggacacggccttgtattactgtgcaaaagatagtatacggtatggcatcacctggggaggttttgactactggggccagggaaccctggtcaccgtctcctca

SEQ ID NO: 686 - protein, 250 aa, Artificial Sequence
  Description of Artificial Sequence: Synthetic polypeptide
LPVLTQPPSVSVSPGQTAIITCSGDKLGEKYVSWYQQKPGQSPVLVIDQDTRRPSGIPERFSGSNSGTTATLTISGTQAMDEADYYCQAWDRGVVFGGGTKLTVLGSRGGGGSGGGGSGGGGSLEMAEVQLVESGGDLVQPGRSLRLSCAASGFTFNDYAMHWVRQAPGKGLEWVSGISWSGNNIGYADSVKGRFTISRDNAKNSLYLQMNSLRAEDTALYYCAKDSIRYGITWGGFDYWGQGTLVTVSS

SEQ ID NO: 687 - DNA, 750 bp, Artificial Sequence
  Description of Artificial Sequence: Synthetic polynucleotide
cagcctgtgctgactcagccaccctcggtgtccaagggcttgagacagaccgccacactcacctgcactgggaacagcaacaatgttggcaacctaggagtagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagtagcctcagtgcttgggtgttcggcggagggaccaagctgaccgtcctaggttctagaggtggtggtggtagcggcggcggcggctctggtggtggtggatccctcgagatggccgaggtgcagctggtggagtctgggggagtcgtggtacagcctggggggtccctgagactctcctgtgcagcctctggattcacctttgatgattatgccatgcactgggtccgtcaagctccggggaagggtctggagtgggtctctcttattaattgggatggtggtagcacctactatgcagactctgtgaagggtcgattcaccatctccagagacaacagcaaaaactccctgtatctgcaaatgaacagtctgagagctgaggacaccgccttgtattactgtgcaaaagggatgggcctgagggcgtttgactactggggccagggaaccctggtcaccgtctcctca

SEQ ID NO: 688 - protein, 250 aa, Artificial Sequence
  Description of Artificial Sequence: Synthetic polypeptide
QPVLTQPPSVSKGLRQTATLTCTGNSNNVGNLGVAWLQQHQGHPPKLLSYRNNNRPSGISERLSASRSGNTASLTITGLQPEDEADYYCSAWDSSLSAWVFGGGTKLTVLGSRGGGGSGGGGSGGGGSLEMAEVQLVESGGVVVQPGGSLRLSCAASGFTFDDYAMHWVRQAPGKGLEWVSLINWDGGSTYYADSVKGRFTISRDNSKNSLYLQMNSLRAEDTALYYCAKGMGLRAFDYWGQGTLVTVSS

SEQ ID NO: 689 - DNA, 765 bp, Artificial Sequence
  Description of Artificial Sequence: Synthetic polynucleotide
cagtctgtgttgactcagccaccctcagcgtctgggacccccgggcagagggtcaccatctcctgttctggaagcagctccaacatcggaagtaatactgtaaactggtaccagcagctcccaggaacggcccccaaactcctcatctatagtaatgatcagcggccctcaggggtccctgaccgattctctggctccaagtccggcacctcagcctccctggccatcagtgggctccagtctgaggatgaggctgattattactgtgcttcatgggatgacagcctgaatggccgttatgtcttcggaactgggaccaaggtcaccgtcctaggttctagaggtggtggtggtagcggcggcggcggctctggtggtggtggatccctcgagatggcccaggtccagctggtacagtctggggctgaggtgaggaagcctggggcctcagtgaaggtttcctgcaagacttctggatacaccttcagttggtatgctatacattgggtgcgccaggcccccggacaaaggcttgagtggatgggatggatcaacgctggcaatggaaacacaaaatattcacagaaatttcagggcagagtcagtcttaccagggacacatccgcgagcacagcctacatggagctgagcagcctgagatctgatgacacggctgtgtattactgtgcgagacccgataattatggttcgggtggggatgtttttgatatctggggccaagggacaatggtcaccgtctcttca

SEQ ID NO: 690 - protein, 255 aa, Artificial Sequence
  Description of Artificial Sequence: Synthetic polypeptide
QSVLTQPPSASGTPGQRVTISCSGSSSNIGSNTVNWYQQLPGTAPKLLIYSNDQRPSGVPDRFSGSKSGTSASLAISGLQSEDEADYYCASWDDSLNGRYVFGTGTKVTVLGSRGGGGSGGGGSGGGGSLEMAQVQLVQSGAEVRKPGASVKVSCKTSGYTFSWYAIHWVRQAPGQRLEWMGWINAGNGNTKYSQKFQGRVSLTRDTSASTAYMELSSLRSDDTAVYYCARPDNYGSGGDVFDIWGQGTMVTVSS

SEQ ID NO: 691 - DNA, 744 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactttgtgcagtggtaccagcagcgcccgggcagtgcccccacccctatgatctatgaggataacaacagaccccctggggtccctgatcggttctctgcctccgtcgacagctcctccaactctgcctccctcaccatctctggactgaagactgaggacgaggctgactactactgtcagtcttatgataccagcaatgtggtattcggcggggggaccaagctgaccgtcctaggttctagaggtggtggtggtagcggcggcggcggctctggtggtggtggatccctcgagatggccgaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcacgctgggactacggtatggacgtctggggccaagggaccacggtcaccgtctcctca

SEQ ID NO: 692 - protein, 248 aa, Artificial Sequence
  Description of Artificial Sequence: Synthetic polypeptide
NFMLTQPHSVSESPGKTVTISCTRSSGSIASNFVQWYQQRPGSAPTPMIYEDNNRPPGVPDRFSASVDSSSNSASLTISGLKTEDEADYYCQSYDTSNVVFGGGTKLTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSS

SEQ ID NO: 693 - DNA, 762 bp, Artificial Sequence
  Description of Artificial Sequence: Synthetic polynucleotide
caggctgtgctgactcagccaccctcagcgtctggggcccccgggcagagggtcaccgtctcttgttctggaagcaactccaacatcggaagtaactacgttaactggtaccagcagttcccaggaacggcccccaaactcctcatgtatagtagtagtcagcggccctcaggggtccctgaccgattctctggctccaagtctggcacctcagcctccctggccatcagtgggctccactctgaggatgaggctgattattactgtgctacatgggatgacagcctgaatgcttgggtgttcggcggagggaccaagctgaccgtcctaggttctagaggtggtggtggtagcggcggcggcggctctggtggtggtggatccctcgagatggccgaggtccagctggtgcagtctggggctgaggtgaggaagcctggggcctcagtgaaggtttcctgcaagacttctggatacaccttcacttggtatgctatacattgggtgcgccaggcccccggacaaaggcttgagtggatgggatggatcaacgctggcagtggaaacacaaaatattcacagaaatttcagggcagagtcacccttaccagggacacatccgcgagcacagcgtacatggagctgagcagcctgagatctgatgacacggctgtgtattactgtgcgagacccaataactatggttcgggtggggatgtttttgatatctggggccaagggacaatggtcaccgtctcttca

SEQ ID NO: 694 - protein, 254 aa, Artificial Sequence
  Description of Artificial Sequence: Synthetic polypeptide
QAVLTQPPSASGAPGQRVTVSCSGSNSNIGSNYVNWYQQFPGTAPKLLMYSSSQRPSGVPDRFSGSKSGTSASLAISGLHSEDEADYYCATWDDSLNAWVFGGGTKLTVLGSRGGGGSGGGGSGGGGSLEMAEVQLVQSGAEVRKPGASVKVSCKTSGYTFTWYAIHWVRQAPGQRLEWMGWINAGSGNTKYSQKFQGRVTLTRDTSASTAYMELSSLRSDDTAVYYCARPNNYGSGGDVFDIWGQGTMVTVSS

SEQ ID NO: 695 - DNA, 759 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgcttatgtcttcggaactgggaccaaggtcaccgtcctaggttctagaggtggtggtggtagcggcggcggcggctctggtggtggtggatccctcgagatggcccaggtccagctggtgcagtctggggctgaggtgaagaagcctggggcctcagtgaaagtttcctgcaaggcttctggatacaccttcacgaactatgctctgcattgggtgcgccaggcccccggacaagggcttgagtggatggcatggatcaacggtggcaatggtaacacaaaatattcacagaacttccagggcagagtcaccattaccagggacacatccgcgagcacagcctatatggagctgagcagcctgagatctgaagacacggctgtgtattactgtgcgaaaccggaggaaacagctggaacaatccactttgactactggggccagggaaccccggtcaccgtctcctca

SEQ ID NO: 696 - protein, 253 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLGSRGGGGSGGGGSGGGGSLEMAQVQLVQSGAEVKKPGASVKVSCKASGYTFTNYALHWVRQAPGQGLEWMAWINGGNGNTKYSQNFQGRVTITRDTSASTAYMELSSLRSEDTAVYYCAKPEETAGTIHFDYWGQGTPVTVSS

SEQ ID NO: 697 - DNA, 774 bp, Artificial Sequence
  Description of Artificial Sequence: Synthetic polynucleotide
caggctgtgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaccatcacggtgttcggcggagggaccaagctgaccgtcctaggttctagaggtggtggtggtagcggcggcggcggctctggtggtggtggatccctcgagatggcccaggtccagctggtacagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgggggagggttactatgatagtagtggttattccaacggtgatgcttttgatatctggggccaagggacaatggtcaccgtctcttca

SEQ ID NO: 698 - protein, 258 aa, Artificial Sequence
  Description of Artificial Sequence: Synthetic polypeptide
QAVLTQPHSVSESPGKTVTISCTRSSGSIASNYVQWYQQRPGSAPTTVIYEDNQRPSGVPDRFSGSIDSSSNSASLTISGLKTEDEADYYCQSYDSTITVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCAGEGYYDSSGYSNGDAFDIWGQGTMVTVSS

SEQ ID NO: 699 - DNA, 744 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatgtggtattcggcggagggaccaaggtcaccgtcctaggttctagaggtggtggtggtagcggcggcggcggctctggtggtggtggatccctcgagatggccgaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcacgctgggactacggtatggacgtctggggccaagggaccacggtcaccgtctcctca

SEQ ID NO: 700 - protein, 248 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNVVFGGGTKVTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSS

SEQ ID NO: 701 - DNA, 753 bp, Artificial Sequence
  Description of Artificial Sequence: Synthetic polynucleotide
tcctatgtgctgactcagccaccctcagtgtccgtgtccccaggacagacagccagcatcacctgctctggagatagattgacgaataaatatgtttcctggtatcaacagaagccaggccagtcccctgtgttggtcatctatgaggatgccaagcggccctcagggatccctgcgcgattctctggctccaactctgggaacacagccactctgaccatcagcgggacccaggctatggatgagtctgaatattactgtcaggcgtgggacagcagtgtggtggtttttggcggagggaccaagctgaccgtcctaggttctagaggtggtggtggtagcggcggcggcggctctggtggtggtggatccctcgagatggccgaggtgcagctggtggagtctgggggaggcttggtacagcctggcaggtccctgagactctcctgtgcagcctctggatttacctttgatgattatgccatgcactgggtccggcaagctccagggaagggcctggagtgggtctcaggtattagttggaatagtggtagtataggctatgcggactctgtgaagggccgattcaccatctccagagacaacgccaagaactccctgtatctgcaaatgaacagtctgagagatgaggacacggccttgtattactgtgcaaaagaccgaggggggggagttatcgttaaggatgcttttgatatctggggccaagggacaatggtcaccgtctcttca

SEQ ID NO: 702 - protein, 251 aa, Artificial Sequence
  Description of Artificial Sequence: Synthetic polypeptide
SYVLTQPPSVSVSPGQTASITCSGDRLTNKYVSWYQQKPGQSPVLVIYEDAKRPSGIPARFSGSNSGNTATLTISGTQAMDESEYYCQAWDSSVVVFGGGTKLTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRDEDTALYYCAKDRGGGVIVKDAFDIWGQGTMVTVSS

SEQ ID NO: 703 - DNA, 750 bp, Artificial Sequence
  Description of Artificial Sequence: Synthetic polynucleotide
tcctatgagctgactcagccacccgcagcgtctgggacccccggacagagagtcaccatctcttgttctgggggcgtctccaacatcgggagtggtgctctaaattggtaccagcaactcccaggaacggcccccaaactcctcatctatagttacaatcagcggccctcaggggtctctgaccgattctctggctccaggtctgccacctcagcctccctggccatcagtgggctccagtctgaggatgaggctgattattactgtgcaacctgggatgatagtgtgaatggttgggtgttcggcggagggaccaagctgaccgtcctaggttctagaggtggtggtggtagcggcggcggcggctctggtggtggtggatccctcgagatggccgaggtgcagctggtggagtctggagctgaggtgaagaagcctggggattcagtgaaggtctcctgcaagccttctggttacaattttctcaactatggtatcaactgggtgcgacaggcccctggacaagggcttgagtggatgggatggattagcacttacaccggtaacacaaactatgcacagaagctgcagggcagagtcaccttcaccacagacacatccacgagcacagcctacatggagatgaggagcctgagatctgacgacacggccgtgtattactgtgcgcgccagcagggtggtggttggtacgatgtttggggtcaaggtactctggtcaccgtctcctca

SEQ ID NO: 704 - protein, 250 aa, Artificial Sequence
  Description of Artificial Sequence: Synthetic polypeptide
SYELTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAEVQLVESGAEVKKPGDSVKVSCKPSGYNFLNYGINWVRQAPGQGLEWMGWISTYTGNTNYAQKLQGRVTFTTDTSTSTAYMEMRSLRSDDTAVYYCARQQGGGWYDVWGQGTLVTVSS

SEQ ID NO: 705 - DNA, 768 bp, Artificial Sequence
  Description of Artificial Sequence: Synthetic polynucleotide
cagtctgtcgtgacgcagccgccctcagtgtctgcggccccaggagagaaggtcaccatctcctgctctggaagcaacttcaatgttggaaataatgatgtatcctggtatcagcaactcccaggtgcagcccccaaactcctcatttatgacaataataagcgaccctcagggattcctgaccgattctctggctccaagtctggcacgtcagccaccctggacatcaccgggctccacagtgacgacgaggccgattattactgcggaacatgggatagcagcctgaatactgggggggtcttcggaactgggaccaaggtcaccgtcctaggttctagaggtggtggtggtagcggcggcggcggctctggtggtggtggatccctcgagatggccgaggtccagctggtgcagtctggagctgaggtgaagaagcctggggcctcagtgaaggtctcctgcaaggcttctggttacacctttaccagctatactatcagctgggtacgacaggcccctggacaagggcttgagtggatgggatggatcagcacttacaatggtctcacaaactatgcacagaacctccagggcagagtcaccatgactacagacacattcacgaccacagcctacatggagctgaggagcctcagatctgacgacacggccgtgtattactgtgtgagagaggggtcccccgactacggtgacttcgcgtcctttgactactggggccagggaaccctggtcaccgtctcctca

SEQ ID NO: 706 - protein, 256 aa, Artificial Sequence
  Description of Artificial Sequence: Synthetic polypeptide
QSVVTQPPSVSAAPGEKVTISCSGSNFNVGNNDVSWYQQLPGAAPKLLIYDNNKRPSGIPDRFSGSKSGTSATLDITGLHSDDEADYYCGTWDSSLNTGGVFGTGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSS

SEQ ID NO: 707 - DNA, 768 bp, Artificial Sequence
  Description of Artificial Sequence: Synthetic polynucleotide
cagtctgtgttgacgcagccgccctcagtgtctgcgcccccgggacagaaggtcaccatctcctgctctggaagcagctccaacattgggaataattatgtatcctggtaccagcagttcccaggaacagcccccaaactcctcatttatgacaataataagcgaccctcagggatttctgaccgattctctggctccaagtctggcacgtcagccaccctgggcatcgccggactccagactggggacgaggccgattattactgcggaacatgggataccagcctgagtggtttttatgtcttcggaagtgggaccaaggtcaccgtcctaggttctagaggtggtggtggtagcggcggcggcggctctggtggtggtggatccctcgagatggccgaggtccagctggtacagtctggagctgaggtgaagaagcctggggcctcagtgaaggtctcctgcaaggcttctggttacacctttaccagctatactatcagctgggtacgacaggcccctggacaagggcttgagtggatgggatggatcagcacttacaatggtctcacaaactatgcacagaacctccagggcagagtcaccatgactacagacacattcacgaccacagcctacatggagctgaggagcctcagatctgacgacacggccgtgtattactgtgtgagagaggggtcccccgactacggtgacttcgcgtcctttgactactggggccagggaaccctggtcaccgtctcctca

SEQ ID NO: 708 - protein, 256 aa, Artificial Sequence
  Description of Artificial Sequence: Synthetic polypeptide
QSVLTQPPSVSAPPGQKVTISCSGSSSNIGNNYVSWYQQFPGTAPKLLIYDNNKRPSGISDRFSGSKSGTSATLGIAGLQTGDEADYYCGTWDTSLSGFYVFGSGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSS

SEQ ID NO: 709 - DNA, 765 bp, Artificial Sequence
  Description of Artificial Sequence: Synthetic polynucleotide
ctgcctgtgctgactcagccaccctcagcgtctgcgacccccgggcagagggtcaccatctcttgttctggaaccacctccaacatcggaagtaatactgtacactggtaccagcagctcccagggacggcccccaaactcctcatctataataataatcagcggccctcaggggtccctgaccgattctctggctccaagtctggcacctcagcctccctggccatcagtgggctccggtccgaggatgaggctacatattcctgtgcaacatgggatgacagcctgagtggtgtggtcttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagatcccgcctacggtgactacgagtatgatgcttttgatatctggggccaagggacaatggtcaccgtctcttca

SEQ ID NO: 710 - protein, 255 aa, Artificial Sequence
  Description of Artificial Sequence: Synthetic polypeptide
LPVLTQPPSASATPGQRVTISCSGTTSNIGSNTVHWYQQLPGTAPKLLIYNNNQRPSGVPDRFSGSKSGTSASLAISGLRSEDEATYSCATWDDSLSGVVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDPAYGDYEYDAFDIWGQGTMVTVSS

SEQ ID NO: 711 - DNA, 750 bp, Artificial Sequence
  Description of Artificial Sequence: Synthetic polynucleotide
cagtctgtgttgacgcagccgccctcagcgtctgggacccccgggcagagggtcaccatctcttgttctggaagcagctccaacatcggaactaatggtgtaaactggttccagcagttcccaggaacggcccccaaactcctcatctatactaatgatcagcggccctcaggggtccctgaccgattctctggctccaagtctggcacctcagcctccctggccatcagtgggctccagtctgcggatgaggctgattattactgtgcagtgtgggaccacagcctgaatggtccggtgttcggcggagggaccaagctgaccgtcctaggttctagaggtggtggtggtagcggcggcggcggctctggtggtggtggatccctcgagatggcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaggggccggttttgatgcttttgatatctggggccaagggacaatggtcaccgtctcttca

SEQ ID NO: 712 - protein, 250 aa, Artificial Sequence
  Description of Artificial Sequence: Synthetic polypeptide
QSVLTQPPSASGTPGQRVTISCSGSSSNIGTNGVNWFQQFPGTAPKLLIYTNDQRPSGVPDRFSGSKSGTSASLAISGLQSADEADYYCAVWDHSLNGPVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGAGFDAFDIWGQGTMVTVSS

SEQ ID NO: 713 - DNA, 744 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgagactgattattactgtgcagcatgggatgacagcctgaatggttatgtcttcggaactgggaccaaggtcaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagaggggctagatgcttttgatatctggggccaagggacaatggtcaccgtctcttca

SEQ ID NO: 714 - protein, 248 aa, Artificial Sequence
  Description of Artificial Sequence: Synthetic polypeptide
QAVLTQPPSASGTPGQRVTISCSGSSSNIGSNTVNWYQQLPGTAPKLLIYSNNQRPSGVPDRFSGSKSGTSASLAISGLQSEDETDYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSS

SEQ ID NO: 715 - DNA, 744 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatgtatagtaatgatcagcggccctcaggggtccctgaccgattctctggctccaagtctggcacctcagcctccctggccatcagtgggctccagtctgaggatgaggctgattattattgtgcagcatgggatgacagcctgaatggttatgtcttcgcagctgggacccagctcaccgttttaagttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagaggggctagatgcttttgatatctggggccaagggacaatggtcaccgtctcttca

SEQ ID NO: 716 - protein, 248 aa, Artificial Sequence
  Description of Artificial Sequence: Synthetic polypeptide
QAVLTQPPSASGTPGQRVTISCSGSSSNIGSNTVNWYQQLPGTAPKLLMYSNDQRPSGVPDRFSGSKSGTSASLAISGLQSEDEADYYCAAWDDSLNGYVFAAGTQLTVLSSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSS

SEQ ID NO: 717 - DNA, 768 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcactggactccagactggggacgaggccgattattactgcggaacatgggatagcagcctgagtgctgcttatgtcttcggaactgggaccaaggtcaccgtcctaggttctagaggtggtggtggtagcggcggcggcggctctggtggtggtggatccctcgagatggcccaggtccagctggtacagtctggagctgaggtgaagaagcctggggcctcagtgaaggtctcctgcaaggcttctggttacagctttaccagctatactatcagctgggttcgacaggcccctggacaaggccttgagtggatgggatgggtcagcacttacaatggtctcagaaactatgcacagaacctccagggcagagtcaccatgactacagacacactcacgaccacagcctacatggagctgaggagcctcagatctgacgacacggccgtgtattattgtgtgagagaggggtcccccgactacggtgacttcgcggcctttgactactggggccagggcaccctggtcaccgtctcctca

SEQ ID NO: 718 - protein, 256 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAAYVFGTGTKVTVLGSRGGGGSGGGGSGGGGSLEMAQVQLVQSGAEVKKPGASVKVSCKASGYSFTSYTISWVRQAPGQGLEWMGWVSTYNGLRNYAQNLQGRVTMTTDTLTTTAYMELRSLRSDDTAVYYCVREGSPDYGDFAAFDYWGQGTLVTVSS

SEQ ID NO: 719 - DNA, 741 bp, Artificial Sequence
  Description of Artificial Sequence: Synthetic polynucleotide
caggctgtgctgactcagccaccctcagcgtctgagacccccgggcagagggtcaccatctcttgttctggaagcaggtccaacatcggaactaatattgtacactggtaccagcagcgcccaggaatggcccccaaactcctcacttatggtagtcggcggccctcaggggtcccggaccgattctctggctccaagtttggcacctcagcctccctggccatcagtgggctccagtctgaggatgaggctgattattattgtgcagcatgggatgacagtctgaatggtccggctttcggcggagggaccaagctgaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagacggtgggggctactttgactactggggccagggaaccctggtcaccgtctcctca

SEQ ID NO: 720 - protein, 247 aa, Artificial Sequence
  Description of Artificial Sequence: Synthetic polypeptide
QAVLTQPPSASETPGQRVTISCSGSRSNIGTNIVHWYQQRPGMAPKLLTYGSRRPSGVPDRFSGSKFGTSASLAISGLQSEDEADYYCAAWDDSLNGPAFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDGGGYFDYWGQGTLVTVSS

SEQ ID NO: 721 - DNA, 762 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaatatcggggcacgttatgatgtacactggtaccagcaactcccaggaacagccccccgactcctcatctctgctaactacgatcggccctcaggggtccctgaccgattctctggctccaagtctggcacctcagcctccctggccatcactgggctccaggctgaggatgaggctgattattactgccagtcctatgacagcagtgtgagtgcttgggtgttcggcggagggaccaaggtcaccgtcctaggttctagaggtggtggtggtagcggcggcggcggctctggtggtggtggatccctcgagatggccgaagtgcagctggtgcagtctggggctgaagtgaaggagcctggggcctcagtgaggatctcctgccaggcatctggatacaacttcatcagttattatatgcactgggtgcggcaggcccctgggcaaggtcttgagtggatgggcaccatcaacccaggcagtggtgagacagactactcacagaagttgcagggcagagtcaccatgaccagggacccgtccacgggtacattcgacatggggctgagcagcctgacatctggggacacggccgtctattattgtgcgacaggtctcatcagaggagctagcgatgcttttaatatctggggccgggggacaatggtcaccgtctcttca

SEQ ID NO: 722 - protein, 254 aa, Artificial Sequence
  Description of Artificial Sequence: Synthetic polypeptide
QSVLTQPPSVSGAPGQRVTISCTGSSSNIGARYDVHWYQQLPGTAPRLLISANYDRPSGVPDRFSGSKSGTSASLAITGLQAEDEADYYCQSYDSSVSAWVFGGGTKVTVLGSRGGGGSGGGGSGGGGSLEMAEVQLVQSGAEVKEPGASVRISCQASGYNFISYYMHWVRQAPGQGLEWMGTINPGSGETDYSQKLQGRVTMTRDPSTGTFDMGLSSLTSGDTAVYYCATGLIRGASDAFNIWGRGTMVTVSS

SEQ ID NO: 723 - DNA, 750 bp, Artificial Sequence
  Description of Artificial Sequence: Synthetic polynucleotide
cagcctgtgctgactcagccaccctcagtgtccgtgtccccaggacagacggccgccatcccctgttctggagataagttgggggataaatttgcttcctggtatcagcagaagccaggccagtcccctgtgctggtcatctatcaagatactaagcggccctcagggatccctgagcgattctctggctccaactctgggaacacagccactctgaccatcagcgggacccaggctatggatgaggctgactattactgtcagacgtgggccagcggcattgtggtgttcggcggagggaccaagctgaccgtcctaggttctagaggtggtggtggtagcggcggcggcggctctggtggtggtggatccctcgagatggcccaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagcgcagtggctggaagggatttgactactggggccagggaaccctggtcaccgtctcctca

SEQ ID NO: 724 - protein, 250 aa, Artificial Sequence
  Description of Artificial Sequence: Synthetic polypeptide
QPVLTQPPSVSVSPGQTAAIPCSGDKLGDKFASWYQQKPGQSPVLVIYQDTKRPSGIPERFSGSNSGNTATLTISGTQAMDEADYYCQTWASGIVVFGGGTKLTVLGSRGGGGSGGGGSGGGGSLEMAQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARERSGWKGFDYWGQGTLVTVSS

SEQ ID NO: 725 - DNA, 759 bp, Artificial Sequence
  Description of Artificial Sequence: Synthetic polynucleotide
gatgttgtgatgactcagtctccaccctccctgtccgtcacccctggagagccggcctccatcacctgcaggtctagtcagagcctcctggaaagaaatgcatacaactacttggattggtacctgcagaggccaggacagtctccacagctcctgatctacttgggttctaatcgggccgccggggtccctgacaggttcagtggcagtggatcaggcagagattttacactgaaaatcagcagagtggagcctgaggatgttggggtttattactgcatgcaagctctacaagctccgttcactttcggcggagggaccaaggtggagatcaaacgttctagaggtggtggtggtagcggcggcggcggctctggtggtggtggatccctcgagatggccgaagtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaatggggcccgtttcaggatgcttttgatatctggggccaagggacaatggtcaccgtctcttca

SEQ ID NO: 726 - protein, 253 aa, Artificial Sequence
  Description of Artificial Sequence: Synthetic polypeptide
DVVMTQSPPSLSVTPGEPASITCRSSQSLLERNAYNYLDWYLQRPGQSPQLLIYLGSNRAAGVPDRFSGSGSGRDFTLKISRVEPEDVGVYYCMQALQAPFTFGGGTKVEIKRSRGGGGSGGGGSGGGGSLEMAEVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKWGPFQDAFDIWGQGTMVTVSS

SEQ ID NO: 727 - DNA, 768 bp, Artificial Sequence
  Description of Artificial Sequence: Synthetic polynucleotide
caggctgtgctgactcagcctgcctccgtgtctgggtctcctggacagtcgatcaccatctcctgcactggaaccagcagtgacgttggtggttataactatgtctcctggtaccaacagcacccgggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcaccccttatgtcttcggagcagggaccaaggtcaccgtcctaggttctagaggtggtggtggtagcggcggcggcggctctggtggtggtggatccctcgagatggccgaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagccaggtggacagcagtggcatcagaccaccactttgactactggggccagggaacgctggtcaccgtctcctca

SEQ ID NO: 728 - protein, 256 aa, Artificial Sequence
  Description of Artificial Sequence: Synthetic polypeptide
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTPYVFGAGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKARWTAVASDHHFDYWGQGTLVTVSS

SEQ ID NO: 729 - DNA, 744 bp, Artificial Sequence
  Description of Artificial Sequence: Synthetic polynucleotide
caggctgtgcttactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaagctgaccgtcctaggttctagaggtggtggtggtagcggcggcggcggctctggtggtggtggatccctcgagatggccgaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagattgggactacatggacgtctggggcaaagggaccacggtcaccgtctcctca

SEQ ID NO: 730 - protein, 248 aa, Artificial Sequence
  Description of Artificial Sequence: Synthetic polypeptide
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDWDYMDVWGKGTTVTVSS

SEQ ID NO: 731 - DNA, 777 bp, Artificial Sequence
  Description of Artificial Sequence: Synthetic polynucleotide
tcctatgagctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggttctagaggtggtggtggtagcggcggcggcggctctggtggtggtggatccctcgagatggccgaggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacctatctcggggagctaacccgcattactactactactacggtatggacgtctggggccaagggaccacggtcaccgtctcctca

SEQ ID NO: 732 - protein, 259 aa, Artificial Sequence
  Description of Artificial Sequence: Synthetic polypeptide
SYELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAEVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSS

SEQ ID NO: 733 - DNA, 780 bp, Artificial Sequence
  Description of Artificial Sequence: Synthetic polynucleotide
cagtctgtgttgacgcagccgccctcagtgtctggggccccagggcagagggtcaccgtctcctgcactgggagcagatccaacatcggggcaggatatgatgtacactggtaccagcaacttccaggaacagcccccaaactcctcatctatggaaatagtaatcggcctccaggggtccctgaccgattctctgggtctaagtctggcacctcagcctccctggtcatcactgggctccaggctgaggatgccgctgattattactgccagtcctatgacaacactgtgcgtgaatcaccttatgtcttcggaactgggaccaaggtcaccgtcctaggttctagaggtggtggtggtagcggcggcggcggctctggtggtggtggatccctcgagatggccgaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagagtaatttagtgtcccggcactactactactacggtatggacgtctggggccaagggaccacggtcaccgtctcctca

SEQ ID NO: 734 - protein, 260 aa, Artificial Sequence
  Description of Artificial Sequence: Synthetic polypeptide
QSVLTQPPSVSGAPGQRVTVSCTGSRSNIGAGYDVHWYQQLPGTAPKLLIYGNSNRPPGVPDRFSGSKSGTSASLVITGLQAEDAADYYCQSYDNTVRESPYVFGTGTKVTVLGSRGGGGSGGGGSGGGGSLEMAEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATESNLVSRHYYYYGMDVWGQGTTVTVSS

SEQ ID NO: 735 - DNA, 792 bp, Artificial Sequence
  Description of Artificial Sequence: Synthetic polynucleotide
ctgcctgtgctgactcagccaccctcagcgtctgggacccccgggcagagggtcaccatctcttgttctggaaccagctccaacatcggaagtaattctgtagactggtaccagcagctcccaggaacggcccccaaactcctcatctatagtaataatcagcggccctcaggggtccctgaccgaatctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggttctagaggtggtggtggtagcggcggcggcggctctggtggtggtggatccctcgagatggccgaagtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagattacggatactatggttcggggagttattcgagcggccccctttactactactacggtatggacgtctggggccaagggaccacggtcaccgtctcctca

SEQ ID NO: 736 - protein, 264 aa, Artificial Sequence
  Description of Artificial Sequence: Synthetic polypeptide
LPVLTQPPSASGTPGQRVTISCSGTSSNIGSNSVDWYQQLPGTAPKLLIYSNNQRPSGVPDRISGSKSGTSASLAISGLQSEDEADYYCAAWDDSLNGYVFGTGTKVTVLGSRGGGGSGGGGSGGGGSLEMAEVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGYYGSGSYSSGPLYYYYGMDVWGQGTTVTVSS

SEQ ID NO: 737 - DNA, 777 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatgtataataatgatcagcggccctcaggggtccctgaccgattctctggctccaagtctggcacctcagcctccctggccatcagtgggctccagtctgaggatgaggctgattattactgtgcagcatgggatgacagcctcaatggttatgtcttcggacctgggaccaaggtcaccgtcctaggttctagaggtggtggtggtagcggcggcggcggctctggtggtggtggatccctcgagatggcccaggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacctatctcggggagctaacccgcattactactactactacggtatggacgtctggggccaagggaccacggtcaccgtctcctca

SEQ ID NO: 738 - protein, 259 aa, Artificial Sequence
  Description of Artificial Sequence: Synthetic polypeptide
QAVLTQPPSASGTPGQRVTISCSGSSSNIGSNTVNWYQQLPGTAPKLLMYNNDQRPSGVPDRFSGSKSGTSASLAISGLQSEDEADYYCAAWDDSLNGYVFGPGTKVTVLGSRGGGGSGGGGSGGGGSLEMAQVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSS

SEQ ID NO: 739 - DNA, 756 bp, Artificial Sequence
  Description of Artificial Sequence: Synthetic polynucleotide
aattttatgctgactcagccccacgctgtgtcggagtctccggggaagacggtaaccatctcctgcacccgcagcagtggcagtattgccagcaactatgtgcagtggtaccagcagcgcccgggcagttccccccgcactgtgatttatgaggataatcaaagaccctctggggtccctggtcggttctctggctccatcgacagctcctccaactctgcctccctcaccatctctggactgaagactgaggacgaggctgactactactgtcagtcttatgattccaccagtgtgcttttcggcggagggaccaagctgaccgtcctaggttctagaggtggtggtggtagcggcggcggcggctctggtggtggtggatccctcgagatggccgaggtccagctggtgcagtctggggctgaggtgaagaagccagggtcctcggtgaaggtctcctgcaaggcctcgggaggcaccttcagcagcaattctctcagctgggtgcgacaggcccctggacaagggcttgagtggatgggaaggatcttccctatcctgggtataacaaactatgcacagaagttccagggcagagtcacgattaccgcggacaaatccacgagcacagcctacatggagctgagcagcctgagatctgaggacacggccgtctattactgtgcgagaggaaactaccaatggtatgatgcttttgatatctggggccaagggacaatggtcaccgtctcttca

SEQ ID NO: 740 - protein, 252 aa, Artificial Sequence
  Description of Artificial Sequence: Synthetic polypeptide
NFMLTQPHAVSESPGKTVTISCTRSSGSIASNYVQWYQQRPGSSPRTVIYEDNQRPSGVPGRFSGSIDSSSNSASLTISGLKTEDEADYYCQSYDSTSVLFGGGTKLTVLGSRGGGGSGGGGSGGGGSLEMAEVQLVQSGAEVKKPGSSVKVSCKASGGTFSSNSLSWVRQAPGQGLEWMGRIFPILGITNYAQKFQGRVTITADKSTSTAYMELSSLRSEDTAVYYCARGNYQWYDAFDIWGQGTMVTVSS

SEQ ID NO: 741 - DNA, 744 bp, Artificial Sequence
  Description of Artificial Sequence: Synthetic polynucleotide
cagcctgtgctgactcagccaccctcagtgtcagtggtcccaggaaagacggccaggattacctgtgggggaaaaaacattggaagtaaaagtgtgcactggtaccagcagaagccaggccaggcccctgtggtggtcatccattatgatagtgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggttctagaggtggtggtggtagcggcggcggcggctctggtggtggtggatccctcgagatggcccaggtgcagctggtgcagtctggagctgaggtgaagaagcctggggcctcagtgaaggtctcctgcaaggcttctggttacacctttaccaactatggtatcagctgggtgcgacaggcccctggacaagggcttgagtggatgggatggatcagcgcttacaatggtaacacaaactatgcacataagctccagggcagagtcaccatgaccacagacacatccacgagcacagccaacatggagctgaggagcctgagacctgacgacactgccgtgtattactgtgcgcgctcttacttcggttctcatgattactggggtcaaggtactctggtgaccgtctcctca

SEQ ID NO: 742 - protein, 248 aa, Artificial Sequence
  Description of Artificial Sequence: Synthetic polypeptide
QPVLTQPPSVSVVPGKTARITCGGKNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAQVQLVQSGAEVKKPGASVKVSCKASGYTFTNYGISWVRQAPGQGLEWMGWISAYNGNTNYAHKLQGRVTMTTDTSTSTANMELRSLRPDDTAVYYCARSYFGSHDYWGQGTLVTVSS

SEQ ID NO: 743 - DNA, 759 bp, Artificial Sequence
  Description of Artificial Sequence: Synthetic polynucleotide
tcctatgtgctgactcagccaccctcggtgtcagtggccccaggaaagacggccaggatttcctgtgggggaaacgacattggaagtaaaagtgttttctggtatcagcagaggccaggccaggcccctgtgttggtcgtctatgatgatagcgaccggccctcagggctccctgagcgattctctggcttcaactctgggaacacggccaccctgaccatcagcagggtcgaagccggggatgaggccgactattactgtcaagtgtgggatagtagtagtgatcattatgtcttcggaactgggaccaaggtcaccgtcctaggttctagaggtggtggtggtagcggcggcggcggctctggtggtggtggatccctcgagatggcccaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatataacctatggttcggggagttatggtgcttttgatatctggggccaagggacaatggtcaccgtctcttca

SEQ ID NO: 744 - protein, 253 aa, Artificial Sequence
  Description of Artificial Sequence: Synthetic polypeptide
SYVLTQPPSVSVAPGKTARISCGGNDIGSKSVFWYQQRPGQAPVLVVYDDSDRPSGLPERFSGFNSGNTATLTISRVEAGDEADYYCQVWDSSSDHYVFGTGTKVTVLGSRGGGGSGGGGSGGGGSLEMAQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDITYGSGSYGAFDIWGQGTMVTVSS

SEQ ID NO: 745 - DNA, 822 bp, Artificial Sequence
  Description of Artificial Sequence: Synthetic polynucleotide
cagtctgtgttgacgcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtgtatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgcgaaggtccgtacgacggtttcgattcttggggtcaaggtactctggtgaccgtctcctcaactagtggccaggccggccagcaccatcaccatcaccatggcgcatacccgtacgacgttccggactacgcttct

SEQ ID NO: 746 - protein, 274 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGPYDGFDSWGQGTLVTVSSTSGQAGQHHHHHHGAYPYDVPDYAS

SEQ ID NO: 747 - DNA, 822 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattctgtggtattcggcggagggaccaagctgaccgtcctaggttctagaggtggtggtggtagcggcggcggcggctctggtggtggtggatccctcgagatggcccaggtccagctggtacagtctggcactgaggtgaagaagcctggggcctcagtgagggtcgcctgcaaggcttctggttacccctttaacaaatatgacatcaactgggtgcgacaggcccctggacaagggcttgagtggatgggaggcatcatccctatctttcgtacaacaaactacgcacagaagttccagggcagagtcacgattaccgcggacgaatccacgagcacagcctacatggagctgagcagcctgagatctgaggacacggccgtatattactgtgcgcgcgaatggttctactgggatatctggggtcaaggtactctggtgaccgtctcctcaactagtggccaggccggccagcaccatcaccatcaccatggcgcatacccgtacgacgttccggactacgcttct

SEQ ID NO: 748 - protein, 274 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSVVFGGGTKLTVLGSRGGGGSGGGGSGGGGSLEMAQVQLVQSGTEVKKPGASVRVACKASGYPFNKYDINWVRQAPGQGLEWMGGIIPIFRTTNYAQKFQGRVTITADESTSTAYMELSSLRSEDTAVYYCAREWFYWDIWGQGTLVTVSSTSGQAGQHHHHHHGAYPYDVPDYAS

SEQ ID NO: 749 - DNA, 825 bp, Artificial Sequence
  Description of Artificial Sequence: Synthetic polynucleotide
cagtctgtgttgactcagccaccctcagtgtccgtgtccccaggacagacagccagcatctcctgctctggaaataaattggggactaagtatgtttactggtatcagaagaggccaggccagtcccctgtgttggtcatgtatgaagataatcagcggccctcagggatcccggagcggttctctggctccaactctgggaacacagccactctgaccatcagagggacccagactgtggatgaggctgactattactgtcaggcgtgggactccgacactttcgtggtcttcggcggagggaccaaggtcaccgtcctaggttctagaggtggtggtggtagcggcggcggcggctctggtggtggtggatccctcgagatggccgaggtgcagctggtggagaccgggggaggcgtggtccagcctgggaggtccctgagactctcctgtgcagcctctggattcaccttcagtagttatggcatgcactgggtccgccaggctccaggcaaggggctggagtgggtggcagttatatcacatgatggaagtaataaatactacgcagactccgtgaagggccgattcaccatctccagagacaattccaaggacacgctgtatctgcaaatgaacagcctgagaggtgaggacacggccgtatattactgtgcgcgctctaaccagtggtctggttacttctctttcgattactggggtcaaggtactctggtgaccgtctcctcaactagtggccaggccggccagcaccatcaccatcaccatggcgcatacccgtacgacgttccggactacgcttct

SEQ ID NO: 750 - protein, 275 aa, Artificial Sequence
  Description of Artificial Sequence: Synthetic polypeptide
QSVLTQPPSVSVSPGQTASISCSGNKLGTKYVYWYQKRPGQSPVLVMYEDNQRPSGIPERFSGSNSGNTATLTIRGTQTVDEADYYCQAWDSDTFVVFGGGTKVTVLGSRGGGGSGGGGSGGGGSLEMAEVQLVETGGGVVQPGRSLRLSCAASGFTFSSYGMHWVRQAPGKGLEWVAVISHDGSNKYYADSVKGRFTISRDNSKDTLYLQMNSLRGEDTAVYYCARSNQWSGYFSFDYWGQGTLVTVSSTSGQAGQHHHHHHGAYPYDVPDYAS

SEQ ID NO: 751 - DNA, 819 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtggtggtcatccattatgatagcgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggttctagaggtggtggtggtagcggcggcggcggctctggtggtggtggatccctcgagatggccgaggtgcagctggtgcagtctggagctgaggtgaagaagcctggggcctcagtgaaggtctcctgcaaggcttctggttacacctttaccacctatggtatcagctgggtgcgacaggcccctggacaagggcttgagtggatgggatggatcaacacttacaatggtcacacaaactatgcacagaagctccagggcagagccacaatgaccgcagacacatccacgaacacagcctacatggagctgaggagcctgagatctgacgacactgccgtgtattactgtgcgcgcgttatctacggttctggtgattactggggtcaaggtactctggtgaccgtctcctcaactagtggccaggccggccagcaccatcaccatcaccatggcgcatacccgtacgacgttccggactacgcttct

SEQ ID NO: 752 - protein, 273 aa, Artificial Sequence
  Description of Artificial Sequence: Synthetic polypeptide
SYVLTQPPSVSVAPGKTARITCGGNNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAEVQLVQSGAEVKKPGASVKVSCKASGYTFTTYGISWVRQAPGQGLEWMGWINTYNGHTNYAQKLQGRATMTADTSTNTAYMELRSLRSDDTAVYYCARVIYGSGDYWGQGTLVTVSSTSGQAGQHHHHHHGAYPYDVPDYAS

SEQ ID NO: 753 - DNA, 813 bp, Artificial Sequence
  Description of Artificial Sequence: Synthetic polynucleotide
tcctatgtgctgactcagccactctcagtgtcagtggccccaggaaagacggccaggattacctgtgggggaaacaacattggaagtaaaactgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatcgggtgttcggcggagggaccaagctgaccgtcctaggttctagaggtggtggtggtagcggcggcggcggctctggtggtggtggatccctcgagatggcccaggtgcagctgcaggagtcgggcccaggactggtgaagccttcggagaccctgtccctcacctgcaatgtctctggttactccatcagcagtggttacttttggggctggatccggcagcccccagggaaggggctggagtggattgggagtatctatcatagtaggagcacctactacaacccgtccctcaagagtcgagtcaccatatcagtagacacgtccaagaaccagttctccctgaagctgaactctgtgaccgccgcagacacggccgtgtattactgtgcgcgcggttacggttacttcgattactggggtcaaggtactctggtgaccgtctcctcaactagtggccaggccggccagcaccatcaccatcaccatggcgcatacccgtacgacgttccggactacgcttct

SEQ ID NO: 754 - protein, 271 aa, Artificial Sequence
  Description of Artificial Sequence: Synthetic polypeptide
SYVLTQPLSVSVAPGKTARITCGGNNIGSKTVHWYQQKPGQAPVLVIYYDSDRPSGIPERFSGSNSGNTATLTISRVEAGDEADYYCQVWDSSSDHRVFGGGTKLTVLGSRGGGGSGGGGSGGGGSLEMAQVQLQESGPGLVKPSETLSLTCNVSGYSISSGYFWGWIRQPPGKGLEWIGSIYHSRSTYYNPSLKSRVTISVDTSKNQFSLKLNSVTAADTAVYYCARGYGYFDYWGQGTLVTVSSTSGQAGQHHHHHHGAYPYDVPDYAS

SEQ ID NO: 755 - DNA, 834 bp, Artificial Sequence
  Description of Artificial Sequence: Synthetic polynucleotide
caatctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttcgaaggtgttcggcggagggaccaagctgaccgtcctaggttctagaggtggtggtggtagcggcggcggcggctctggtggtggtggatccctcgagatggccgaggtgcagctggtggagtctgggggaggtgtggtacggcctggggggtccctgagactctcctgtgcagcctctggattcacctttggtgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccgtatattactgtgcgcgctctaaatacaacttccatgtttactacgattactggggtcaaggtactctggtgaccgtctcctcaactagtggccaggccggccagcaccatcaccatcaccatggcgcatacccgtacgacgttccggactacgcttct

SEQ ID NO: 756 - protein, 278 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTSKVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSSTSGQAGQHHHHHHGAYPYDVPDYAS

SEQ ID NO: 757 - DNA, 831 bp, Artificial Sequence
  Description of Artificial Sequence: Synthetic polynucleotide
cagtctgtgttgacgcagccaccctcagcgtctgggacccccgggcagacagtcaccatctcttgttctggaagcaactccaacatcggaagtaattatgtatactggtaccagcagctcccaggaacggcccccaaactcctcatctataggaataatcagcggccctcaggggtccctgaccgattctcaggctccaagtctggcacctcagcctccctggccatcagtgggctccgctccgaggatgaggctgattattactgtgcagcatgggatgacagcctgagtgcttatgtcttcggaactgggaccaaggtcaccgtcctaggttctagaggtggtggtggtagcggcggcggcggctctggtggtggtggatccctcgagatggcccaggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacactgccgtgtattactgtgcgcgctcttctggtaacatggtttcttggaaagatatgtggggtcaaggtactctggtgaccgtctcctcaactagtggccaggccggccagcaccatcaccatcaccatggcgcatacccgtacgacgttccggactacgcttct

SEQ ID NO: 758 - protein, 277 aa, Artificial Sequence
  Description of Artificial Sequence: Synthetic polypeptide
QSVLTQPPSASGTPGQTVTISCSGSNSNIGSNYVYWYQQLPGTAPKLLIYRNNQRPSGVPDRFSGSKSGTSASLAISGLRSEDEADYYCAAWDDSLSAYVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSSGNMVSWKDMWGQGTLVTVSSTSGQAGQHHHHHHGAYPYDVPDYAS

SEQ ID NO: 759 - DNA, 822 bp, Artificial Sequence
  Description of Artificial Sequence: Synthetic polynucleotide
caatctgccctgactcagcctgcctccgtgtctgggtctcctggacagtcgatcaccatctcctgcactggaaccagcagtgacgttggtggttataactctgtctcctggtaccaacaacacccaggcaaagcccccagactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacccctttagtcttcggaactgggaccaaggtcaccgtcctaggttctagaggtggtggtggtagcggcggcggcggctctggtggtggtggatccctcgagatggcccaggtgcagctggtgcagtctggggctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgcggtgctgttgcttaccatgattggggtcaaggtactctggtgaccgtctcctcaactagtggccaggccggccagcaccatcaccatcaccatggcgcatacccgtacgacgttccggactacgcttct

SEQ ID NO: 760 - protein, 274 aa, Artificial Sequence
  Description of Artificial Sequence: Synthetic polypeptide
QSALTQPASVSGSPGQSITISCTGTSSDVGGYNSVSWYQQHPGKAPRLMIYDVSNRPSGVSNRFSGSKSGNTASLTISGLQAEDEADYYCSSYTSSSTPLVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSSTSGQAGQHHHHHHGAYPYDVPDYAS

SEQ ID NO: 761 - DNA, 825 bp, Artificial Sequence
  Description of Artificial Sequence: Synthetic polynucleotide
cagtctgtcgtgacgcagccgccctcagtgtctgcggccccaggacagagggtcaccatctcctgctctggaagcagctccaacatttcgatttatgatgtatcctggtatcagcagctcccaggaacagcccccaaactcctcatttatggcaataataagcgaccctcggggattgctgaccgattctctggctccacgtctggcacgtcagccaccctgggcatcaccggactccagactggggacgaggccgattattactgcggaacatgggatgacagtctgagtgggggggtgttcggcggagggaccaagctgaccgtcctaggttctagaggtggtggtggtagcggcggcggcggctctggtggtggtggatccctcgagatggcccagatgcagctggtgcaatctggggctgaggtgaagaagcctgggtcctcggtgaaggtctcctgcgaggcttctggaggcaccctcagcagctatgctatcaactgggtgcgacaggcccctggacaagggcttgagtggatgggagggatcatccctatgtttggtacagcacactacgcacagaagttccagggcagagtcacgattaccgcggacgaatccacgaaaacagcctacatggagctgagcagcctgagatctgaggacactgccgtgtattactgtgcgcgcggtgttcattacgcttctttcgatcattggggtcaaggtactctggtgaccgtctcctcaactagtggccaggccggccagcaccatcaccatcaccatggcgcatacccgtacgacgttccggactacgcttct

SEQ ID NO: 762 - protein, 275 aa, Artificial Sequence
  Description of Artificial Sequence: Synthetic polypeptide
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLGSRGGGGSGGGGSGGGGSLEMAQMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSSTSGQAGQHHHHHHGAYPYDVPDYAS

SEQ ID NO: 763 - DNA, 822 bp, Artificial Sequence
  Description of Artificial Sequence: Synthetic polynucleotide
cagtctgtgttgacgcagccgccctcagtgtctgcggccgcaggacagaaggtcaccatctcctgctctggaagcgactccaacattgggaataattatgtgtcctggtatcaacacctcccagggacagcccccaaactcctcatttatgacgttaaaaatcgaccctcagggattcctgaccggttctccggctccaagtctggctcgtcagccaccctaggcatcgccggactccagcctggggacgaggccgattattactgcggaacatgggacagtcggctggatgcctatgtcttcggaactgggaccaaggtcaccgtcctaggttctagaggtggtggtggtagcggcggcggcggctctggtggtggtggatccctcgagatggcccagatgcagctggtgcaatctggagctgaggtgaagaagcctggggcctcagtgaaggtctcctgcaagacttctggtttcccctttaatatctttggaatcacctgggtgcgacaggcccctggacaagggcttgagtggatgggatggatcagcggttacaacggtaacacagactacccacagaagttccagggcagagtcaccatgtccacagacacatccacgagtacagcctacatggagctgaggaacctgaaatctgacgacacggccgtgtattactgtgcgcgcggtgcttacggtggtatggatacttggggtcaaggtactctggtgaccgtctcctcaactagtggccaggccggccagcaccatcaccatcaccatggcgcatacccgtacgacgttccggactacgcttct

SEQ ID NO: 764 - protein, 274 aa, Artificial Sequence
  Description of Artificial Sequence: Synthetic polypeptide
QSVLTQPPSVSAAAGQKVTISCSGSDSNIGNNYVSWYQHLPGTAPKLLIYDVKNRPSGIPDRFSGSKSGSSATLGIAGLQPGDEADYYCGTWDSRLDAYVFGTGTKVTVLGSRGGGGSGGGGSGGGGSLEMAQMQLVQSGAEVKKPGASVKVSCKTSGFPFNIFGITWVRQAPGQGLEWMGWISGYNGNTDYPQKFQGRVTMSTDTSTSTAYMELRNLKSDDTAVYYCARGAYGGMDTWGQGTLVTVSSTSGQAGQHHHHHHGAYPYDVPDYAS

SEQ ID NO: 765 - DNA, 828 bp, Artificial Sequence
  Description of Artificial Sequence: Synthetic polynucleotide
cagtctgtcgtgacgcagccgccctcagtgtctggggccccagggcagagggtcaccatctcctgcactgggagcacctccaacatcggggcaggttatgatgtacactggtatcagcagcttccaggaacagcccccaaactcctcatctatactaacaactttcggccctcaggggtccctgaccgattctctgcctccaagtctggcacttcagcttccctggccatcactggtctccaggctgaggatgaggctgattattactgcggaacatgggatagcagcctgagtgccgttgtgttcggcggagggaccaagctgaccgtcctaggttctagaggtggtggtggtagcggcggcggcggctctggtggtggtggatccctcgagatggccgaggtgcagctggtggagtctggaactgaggtgaagaagcctggggcctcagtgaaagtctcctgcaaggcttctggttacatgtttaccagttatggtctcaactgggtgcgacaggcccctggacaagggcttgagtggatgggatggatcagcgctaacaatggtaagacaaattatgctaagaaattccaggacagagtcaccatgaccagagacacttccacgagcacaggctacatggaactgaggagcctgagatctgacgacacggccgtatattactgtgcgcgccatatcggtggttcttacttcgatcgttggggtcaaggtactctggtgaccgtctcctcaactagtggccaggccggccagcaccatcaccatcaccatggcgcatacccgtacgacgttccggactacgcttct

SEQ ID NO: 766 - protein, 276 aa, Artificial Sequence
  Description of Artificial Sequence: Synthetic polypeptide
QSVVTQPPSVSGAPGQRVTISCTGSTSNIGAGYDVHWYQQLPGTAPKLLIYTNNFRPSGVPDRFSASKSGTSASLAITGLQAEDEADYYCGTWDSSLSAVVFGGGTKLTVLGSRGGGGSGGGGSGGGGSLEMAEVQLVESGTEVKKPGASVKVSCKASGYMFTSYGLNWVRQAPGQGLEWMGWISANNGKTNYAKKFQDRVTMTRDTSTSTGYMELRSLRSDDTAVYYCARHIGGSYFDRWGQGTLVTVSSTSGQAGQHHHHHHGAYPYDVPDYAS

SEQ ID NO: 767 - DNA, 822 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcattatgtcttcggaactgggaccaaggtcaccgtcctaggttctagaggtggtggtggtagcggcggcggcggctctggtggtggtggatccctcgagatggccgaggtgcagctggtggagactgggggaggcttggtacagcctggggggtccctgagactctcctgtgcagcctctggattcacctttagcagctatgccatgagctgggtccgccaggctccagggaaggggctggagtgggtctcagctattagtggtagtgatggtagcacatactacgcagactccgtgaagggccggttcaccatctccagagacaattccaagaacacgctgtatctgcaaatgaacagcctgagagacgaggacacggccgtatattactgtgcgcgctctcatgaagctaacctggttggtgattggtggggtcaaggtactctggtgaccgtctcctcaactagtggccaggccggccagcaccatcaccatcaccatggcgcatacccgtacgacgttccggactacgcttct

SEQ ID NO: 768 - protein, 274 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKVTVLGSRGGGGSGGGGSGGGGSLEMAEVQLVETGGGLVQPGGSLRLSCAASGFTFSSYAMSWVRQAPGKGLEWVSAISGSDGSTYYADSVKGRFTISRDNSKNTLYLQMNSLRDEDTAVYYCARSHEANLVGDWWGQGTLVTVSSTSGQAGQHHHHHHGAYPYDVPDYAS

SEQ ID NO: 769 - DNA, 816 bp, Artificial Sequence
  Description of Artificial Sequence: Synthetic polynucleotide
cagtctgtggtgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatgtggtattcggcggagggaccaagctgaccgtcctaggttctagaggtggtggtggtagcggcggcggcggctctggtggtggtggatccctcgagatggccgaggtccagctggtacagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgctggggtggtttcggtgctgttgatcattggggtcaaggtactctggtgaccgtctcctcaactagtggccaggccggccagcaccatcaccatcaccatggcgcatacccgtacgacgttccggactacgcttct

SEQ ID NO: 770 - protein, 272 aa, Artificial Sequence
  Description of Artificial Sequence: Synthetic polypeptide
QSVVTQPPSVSVAPGKTARITCGGNNIGSKSVHWYQQKPGQAPVLVIYYDSDRPSGIPERFSGSNSGNTATLTISRVEAGDEADYYCQVWDSSSDVVFGGGTKLTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARWGGFGAVDHWGQGTLVTVSSTSGQAGQHHHHHHGAYPYDVPDYAS

SEQ ID NO: 771 - DNA, 810 bp, Artificial Sequence
  Description of Artificial Sequence: Synthetic polynucleotide
tcttctgagctgactcaggaccctgctgtgtctgtggccttgggacagacagtcaagatcacgtgccaaggagacagcctcacagactaccatgcaacctggtaccagcagaagccaggacaggcccctgtcgctgtcatctatgctacaaacaaccggcccactgggatcccagaccgattctctggttccagttccggaaacacagcttctttgaccatcactggggctcaggcggaagatgaggctgactattactgtaattcccgggacagcggcacggacgaagtgttattcggcggagggaccaagctgaccgtcctaggttctagaggtggtggtggtagcggcggcggcggctctggtggtggtggatccctcgagatggccgaggtgcagctggtggagactgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggccgtgtattactgtgcgcgcggtcagggttacgattactggggtcaaggtactctggtgaccgtctcctcaactagtggccaggccggccagcaccatcaccatcaccatggcgcatacccgtacgacgttccggactacgcttct

SEQ ID NO: 772 - protein, 270 aa, Artificial Sequence
  Description of Artificial Sequence: Synthetic polypeptide
SSELTQDPAVSVALGQTVKITCQGDSLTDYHATWYQQKPGQAPVAVIYATNNRPTGIPDRFSGSSSGNTASLTITGAQAEDEADYYCNSRDSGTDEVLFGGGTKLTVLGSRGGGGSGGGGSGGGGSLEMAEVQLVETGGGLVKPGGSLRLSCAASGFTFSSYSMNWVRQAPGKGLEWVSSISSSSSYIYYADSVKGRFTISRDNAKNSLYLQMNSLRAEDTAVYYCARGQGYDYWGQGTLVTVSSTSGQAGQHHHHHHGAYPYDVPDYAS

SEQ ID NO: 773 - DNA, 810 bp, Artificial Sequence
  Description of Artificial Sequence: Synthetic polynucleotide
tcctatgtgctgactcagccaccctcggtgtcagtggccccaggaaagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgagcatcagcagggtcgaagccggggatgaggccgactattactgtcaggtgtgggatagtagtagtgatcatactgtcttcggaactgggaccaaggtcaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgctactacccgggtatggatatgtggggtcaaggtactctggtgaccgtctcctcaactagtggccaggccggccagcaccatcaccatcaccatggcgcatacccgtacgacgttccggactacgcttct

SEQ ID NO: 774 - protein, 270 aa, Artificial Sequence
  Description of Artificial Sequence: Synthetic polypeptide
SYVLTQPPSVSVAPGKTARITCGGNNIGSKSVHWYQQKPGQAPVLVVYDDSDRPSGIPERFSGSNSGNTATLSISRVEAGDEADYYCQVWDSSSDHTVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARYYPGMDMWGQGTLVTVSSTSGQAGQHHHHHHGAYPYDVPDYAS

SEQ ID NO: 775 - DNA, 816 bp, Artificial Sequence
  Description of Artificial Sequence: Synthetic polynucleotide
caggctgtgctgactcagccgccctcaacgtctgggacccccgggcagagggtcaccatctcttgttctggaagcagctccaacatcgggagaaatggtgtaaactggtaccagcagctcccaggagcggcccccaaagtcctcatctataatgataatcagcgaccctcaggggtccctgaccgagtctctggctcccagtctggctcctcaggcaccctggccatcgatgggcttcggtctgaggatgaggctgattattactgtgcggcatgggatgacagcctgcatggtgtggtattcggcggagggaccaagctgaccgtcctaggttctagaggtggtggtggtagcggcggcggcggctctggtggtggtggatccctcgagatggcccaggtccagctggtacagtctggggctgaggtgaagaagcctggggcctcagtgaaggtctcctgcaaggtttccggatacaccctcaatgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgcggtggttacggtgattcttggggtcaaggtactctggtgaccgtctcctcaactagtggccaggccggccagcaccatcaccatcaccatggcgcatacccgtacgacgttccggactacgcttct

SEQ ID NO: 776 - protein, 272 aa, Artificial Sequence
  Description of Artificial Sequence: Synthetic polypeptide
QAVLTQPPSTSGTPGQRVTISCSGSSSNIGRNGVNWYQQLPGAAPKVLIYNDNQRPSGVPDRVSGSQSGSSGTLAIDGLRSEDEADYYCAAWDDSLHGVVFGGGTKLTVLGSRGGGGSGGGGSGGGGSLEMAQVQLVQSGAEVKKPGASVKVSCKVSGYTLNELSMHWVRQAPGKGLEWMGGFDPEDGETIYAQKFQGRVTMTEDTSTDTAYMELSSLRSEDTAVYYCARGGYGDSWGQGTLVTVSSTSGQAGQHHHHHHGAYPYDVPDYAS

SEQ ID NO: 777 - DNA, 870 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattcttgggtgttcggcggagggaccaagctgaccgtcctaggttctagaggtggtggtggtagcggcggcggcggctctggtggtggtggatccctcgagatggcccaggtgcagctggtgcaatctggggctgaggtgaagaggcctgggtcctcggtgaaggtctcctgcacggcttctggaggcaccttcagcagcgatgctatcagctgggtgcgacaggcccctggacaagggcttgagtggatgggaggaatcatccctatgtttggtacagcaaactacgcacagaagttccagggcagagtcacgattaccgcggacgaatccacgagcacagcctacatggagctgagcagcctgagatctgaggacacggccgtgtattactgtgcgcgcgaaggttactactacccgtctgcttacctgggttctgttctgaacgacatctcttctgtttacgatgaatggggtcaaggtactctggtgaccgtctcctcaactagtggccaggccggccagcaccatcaccatcaccatggcgcatacccgtacgacgttccggactacgcttct

SEQ ID NO: 778 - protein, 290 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSWVFGGGTKLTVLGSRGGGGSGGGGSGGGGSLEMAQVQLVQSGAEVKRPGSSVKVSCTASGGTFSSDAISWVRQAPGQGLEWMGGIIPMFGTANYAQKFQGRVTITADESTSTAYMELSSLRSEDTAVYYCAREGYYYPSAYLGSVLNDISSVYDEWGQGTLVTVSSTSGQAGQHHHHHHGAYPYDVPDYAS

SEQ ID NO: 779 - DNA, 822 bp, Artificial Sequence
  Description of Artificial Sequence: Synthetic polynucleotide
cagtctgtcgtgacgcagccgccctcagtgtctgcggccccaggacagaaggtcaccatctcctgctctggaagcacctccaacattggaaataatgatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcgtgagtgcttcttgggtcttcggcagagggaccaagctgaccgtcctaggttctagaggtggtggtggtagcggcggcggcggctctggtggtggtggatccctcgagatggcccaggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatccacagaagctccagggcagagtcaccatgaccacagacccatccacgagcacagcctacatggagctgaggagcctgagatctgacgacacggccgtgtattactgtgcgcgctctatgacttctttcgattactggggtcaaggtactctggtgaccgtctcctcaactagtggccaggccggccagcaccatcaccatcaccatggcgcatacccgtacgacgttccggactacgcttct

SEQ ID NO: 780 - protein, 274 aa, Artificial Sequence
  Description of Artificial Sequence: Synthetic polypeptide
QSVVTQPPSVSAAPGQKVTISCSGSTSNIGNNDVSWYQQLPGTAPKLLIYDNNKRPSGIPDRFSGSKSGTSATLGITGLQTGDEADYYCGTWDSSVSASWVFGRGTKLTVLGSRGGGGSGGGGSGGGGSLEMAQVQLVQSGAEVKKPGASVKVSCKASGYTFTSYGISWVRQAPGQGLEWMGWISAYNGNTNYPQKLQGRVTMTTDPSTSTAYMELRSLRSDDTAVYYCARSMTSFDYWGQGTLVTVSSTSGQAGQHHHHHHGAYPYDVPDYAS

SEQ ID NO: 781 - DNA, 822 bp, Artificial Sequence
  Description of Artificial Sequence: Synthetic polynucleotide
cagtctgtgttgacgcagccgccctcagtgtctgcggccccaggacagaaggtcaccatctcctgctctggaagcaactccaacattgggaataattatgtatcctggtatcagcaactcccagggacagcccccaaactcctcatttatgacaataataagcgaccctcagggattcctgaccgattctctggctccaggtctggcacgtcagccaccctgggcatcaccggactccagactggggacgaggccgattattactgcggaacatggaataccactgtgactcctggctatgtcttcggaactgggaccaaggtcaccgtcctaggttctagaggtggtggtggtagcggcggcggcggctctggtggtggtggatccctcgagatggccgaagtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacaccgccatgtattactgtgcgcgctctgtttacgacctggatacttggggtcaaggtactctggtgaccgtctcctcaactagtggccaggccggccagcaccatcaccatcaccatggcgcatacccgtacgacgttccggactacgcttct

SEQ ID NO: 782 - protein, 274 aa, Artificial Sequence
  Description of Artificial Sequence: Synthetic polypeptide
QSVLTQPPSVSAAPGQKVTISCSGSNSNIGNNYVSWYQQLPGTAPKLLIYDNNKRPSGIPDRFSGSRSGTSATLGITGLQTGDEADYYCGTWNTTVTPGYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAMYYCARSVYDLDTWGQGTLVTVSSTSGQAGQHHHHHHGAYPYDVPDYAS

SEQ ID NO: 783 - DNA, 831 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgggggccccttatgtcttcggaactgggaccaaggtcaccgtcctaggttctagaggtggtggtggtagcggcggcggcggctctggtggtggtggatccctcgagatggccgaggtgcagctggtgcagtcttggggaggctcggaacagcctggcaggtccctgagactctcctgtgcagcctctggattcacctttgatgattatgccatgcactgggtccggcaagctccagggaagggcctggagtgggtctcaggtattagttggaatagcggtagcataggctatgcggactctgtgaagggccgattcaccatctccagagacaacgccaagaattccctgtatctgcaaatgaacagtctgagagctgaggacaccgccatgtattactgtgcgcgctaccgtcaggttggttctgcttacgattcttggggtcaaggtactctggtgaccgtctcctcaactagtggccaggccggccagcaccatcaccatcaccatggcgcatacccgtacgacgttccggactacgcttct

SEQ ID NO: 784 - protein, 277 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLGAPYVFGTGTKVTVLGSRGGGGSGGGGSGGGGSLEMAEVQLVQSWGGSEQPGRSLRLSCAASGFTFDDYAMHWVRQAPGKGLEWVSGISWNSGSIGYADSVKGRFTISRDNAKNSLYLQMNSLRAEDTAMYYCARYRQVGSAYDSWGQGTLVTVSSTSGQAGQHHHHHHGAYPYDVPDYAS

SEQ ID NO: 785 - DNA, 822 bp, Artificial Sequence
  Description of Artificial Sequence: Synthetic polynucleotide
ctgcctgtgctgactcagccaccctcggtgtcagtggccccaggaaagacggccaggattacctgtgggggaaacaacattggaagtaaaagtgtgcactggtatcagcagaagccaggccaggcccctgtgctggtcgtctatgctgatagcgaccggccctcagggatccctgagcgattctctggctccaactctgggaacacggccaccctgaccatcagcagggtcgaagccggggatgaggccgactattactgtcaggtgtgggatagtagtagttatcataattatgtcttcggaactgggaccaaggtcaccgtcctaggttctagaggtggtggtggtagcggcggcggcggctctggtggtggtggatccctcgagatggccgaggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgaggacaccgccatgtattactgtgcgcgctactggggtttcggtgtttctgatcgttggggtcaaggtactctggtgaccgtctcctcaactagtggccaggccggccagcaccatcaccatcaccatggcgcatacccgtacgacgttccggactacgcttct

SEQ ID NO: 786 - protein, 274 aa, Artificial Sequence
  Description of Artificial Sequence: Synthetic polypeptide
LPVLTQPPSVSVAPGKTARITCGGNNIGSKSVHWYQQKPGQAPVLVVYADSDRPSGIPERFSGSNSGNTATLTISRVEAGDEADYYCQVWDSSSYHNYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELSSLRSEDTAMYYCARYWGFGVSDRWGQGTLVTVSSTSGQAGQHHHHHHGAYPYDVPDYAS

SEQ ID NO: 787 - DNA, 825 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccccgatcggttctctggctccatcgacagctcctccaactctgcctccctcaccatctctggactgaagactgaggacgaggctgactactactgtcagtcttatgacagcagcaatctttgggtgttcggcggagggaccaagctgaccgtcctaggttctagaggtggtggtggtagcggcggcggcggctctggtggtggtggatccctcgagatggcccagatgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgctacaactactactactacgattcttggggtcaaggtactctggtgaccgtctcctcaactagtggccaggccggccagcaccatcaccatcaccatggcgcatacccgtacgacgttccggactacgcttct

SEQ ID NO: 788 - protein, 275 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNLWVFGGGTKLTVLGSRGGGGSGGGGSGGGGSLEMAQMQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYYYDSWGQGTLVTVSSTSGQAGQHHHHHHGAYPYDVPDYAS

SEQ ID NO: 789 - DNA, 816 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaacgttctagaggtggtggtggtagcggcggcggcggctctggtggtggtggatccctcgagatggccgaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacaccgccatgtattactgtgcgcgctactggggttacgactcttacgatgaatggggtcaaggtactctggtgaccgtctcctcaactagtggccaggccggccagcaccatcaccatcaccatggcgcatacccgtacgacgttccggactacgcttct

SEQ ID NO: 790 - protein, 272 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKRSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAMYYCARYWGYDSYDEWGQGTLVTVSSTSGQAGQHHHHHHGAYPYDVPDYAS

SEQ ID NO: 791 - DNA, 822 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgcaacaaccattactacaacgattactggggtcaaggtactctggtgaccgtctcctcaactagtggccaggccggccagcaccatcaccatcaccatggcgcatacccgtacgacgttccggactacgcttct

SEQ ID NO: 792 - protein, 274 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARNNHYYNDYWGQGTLVTVSSTSGQAGQHHHHHHGAYPYDVPDYAS

SEQ ID NO: 793 - DNA, 852 bp, Artificial Sequence
  Description of Artificial Sequence: Synthetic polynucleotide
cagtctgtgttgacgcagccgccctcagtgtctggggccccagggcagggggtcaccatcccctgcactgggagcagctccaacatcggggcaggttatgatgtacactggtaccagcagcttccagggacagcccccaaactcctcatctatggtaacaacaatcggccctcaggggtccctgaccgcttctctggctccaggtctggctcctcagcctccctggccatcactgggctccaggctgaggatgaggctgattattactgccagtcctatgacagcagcctgagtgatgtggtattcggcggagggaccaaggtcaccgtcctaggttctagaggtggtggtggtagcggcggcggcggctctggtggtggtggatccctcgagatggccgaggtccagctggtgcagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcgcgctactggtcttactctttcgactacctgtacatgccggaaggtaacgattggtggggtcaaggtactctggtgaccgtctcctcaactagtggccaggccggccagcaccatcaccatcaccatggcgcatacccgtacgacgttccggactacgcttct

SEQ ID NO: 794 - protein, 284 aa, Artificial Sequence
  Description of Artificial Sequence: Synthetic polypeptide
QSVLTQPPSVSGAPGQGVTIPCTGSSSNIGAGYDVHWYQQLPGTAPKLLIYGNNNRPSGVPDRFSGSRSGSSASLAITGLQAEDEADYYCQSYDSSLSDVVFGGGTKVTVLGSRGGGGSGGGGSGGGGSLEMAEVQLVQSGAEVKKPGATVKISCKVSGYTFTDYYMHWVQQAPGKGLEWMGLVDPEDGETIYAEKFQGRVTITADTSTDTAYMELSSLRSEDTAVYYCARYWSYSFDYLYMPEGNDWWGQGTLVTVSSTSGQAGQHHHHHHGAYPYDVPDYAS

SEQ ID NO: 795 - DNA, 828 bp, Artificial Sequence
  Description of Artificial Sequence: Synthetic polynucleotide
cagtctgtgttgactcagccacccgcagcgtctgggacccccggacagagagtcaccatctcttgttctgggggcgtctccaacatcgggagtggtgctctaaattggtaccagcaactcccaggaacggcccccaaactcctcatctatagttacaatcagcggccctcaggggtctctgaccgattctctggctccaggtctgccacctcagcctccctggccatcagtgggctccagtctgaggatgaggctgattattactgtgcaacctgggatgatagtgtgaatggttgggtgttcggcggagggaccaagctgaccgtcctaggttctagaggtggtggtggtagcggcggcggcggctctggtggtggtggatccctcgagatggcccaggtccagctggtacagtctggagctgaggtgaagaagcctggggattcagtgaaggtctcctgcaagccttctggttacaattttctcaactatggtatcaactgggtgcgacaggcccctggacaagggcttgagtggatgggatggattagcacttacaccggtaacacaaactatgcacagaagctgcagggcagagtcaccttcaccacagacacatccacgagcacagcctacatggagatgaggagcctgagatctgacgacacggccgtgtattactgtgcgcgcgacctgtactactacgaaggtgttgattactggggtcaaggtactctggtgaccgtctcctcaactagtggccaggccggccagcaccatcaccatcaccatggcgcatacccgtacgacgttccggactacgcttct

SEQ ID NO: 796 - protein, 276 aa, Artificial Sequence
  Description of Artificial Sequence: Synthetic polypeptide
QSVLTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAQVQLVQSGAEVKKPGDSVKVSCKPSGYNFLNYGINWVRQAPGQGLEWMGWISTYTGNTNYAQKLQGRVTFTTDTSTSTAYMEMRSLRSDDTAVYYCARDLYYYEGVDYWGQGTLVTVSSTSGQAGQHHHHHHGAYPYDVPDYAS

SEQ ID NO: 797 - DNA, 822 bp, Artificial Sequence
  Description of Artificial Sequence: Synthetic polynucleotide
caggctgtgctgactcagccaccctcagtgtcagtggccccaggaaagacggccagggttacctgtgggggaaacaacattggaagtgaaagtgtgcactggtaccagcagaagccaggccaggcccctgtgttggtcatctattatgataccgaccggccctcagggatccctgagcgattctctggctcccactctgggaccacggccaccctgaccatcagcagggtcgaagccggggatgaggccgactattactgtcaggtgtgggatagtagtagggatcatgtggtattcggcggagggaccaagctgaccgtcctaggttctagaggtggtggtggtagcggcggcggcggctctggtggtggtggatccctcgagatggcccaggtgcagctggtgcagtctgggggaggcgtggtccagcctgggaggtccctgagactctcctgtgcggcctctggattcaccttcagtagctatgctatgcactgggtccgccaggctccaggcaagggactggagtgggtggcagttatatcatatgatggaagcaataaatactacgcagactccgtgaagggcctattcaccatctccagagacaattccaagaacacgctgtatctgcaaatgaacagcctgagagctgaggacacggccgtgtattactgtgcgcgctcttacttcacttctggtttctacgattactggggtcaaggtactctggtgaccgtctcctcaactagtggccaggccggccagcaccatcaccatcaccatggcgcatacccgtacgacgttccggactacgcttct

SEQ ID NO: 798 - protein, 274 aa, Artificial Sequence
  Description of Artificial Sequence: Synthetic polypeptide
QAVLTQPPSVSVAPGKTARVTCGGNNIGSESVHWYQQKPGQAPVLVIYYDTDRPSGIPERFSGSHSGTTATLTISRVEAGDEADYYCQVWDSSRDHVVFGGGTKLTVLGSRGGGGSGGGGSGGGGSLEMAQVQLVQSGGGVVQPGRSLRLSCAASGFTFSSYAMHWVRQAPGKGLEWVAVISYDGSNKYYADSVKGLFTISRDNSKNTLYLQMNSLRAEDTAVYYCARSYFTSGFYDYWGQGTLVTVSSTSGQAGQHHHHHHGAYPYDVPDYAS

SEQ ID NO: 799 - DNA, 825 bp, Artificial Sequence
  Description of Artificial Sequence: Synthetic polynucleotide
cagtctgtcgtgacgcagccgccctcagtgtctggggccccagggcagagggtcaccatctcctgcactgggagcagttccaacatcggggcaggttatgatgtaaattggtatcagcagtttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggctcttatgtcttcggaactgggaccaaggtcaccgtcctaggttctagaggtggtggtggtagcggcggcggcggctctggtggtggtggatccctcgagatggcccagatgcagctggtgcagtctggggctgaggtgaagaagcctggggcctcagtgaaggtctcctgcaaggcttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgcatgtcttctatgtactacgattggggtcaaggtactctggtgaccgtctcctcaactagtggccaggccggccagcaccatcaccatcaccatggcgcatacccgtacgacgttccggactacgcttct

SEQ ID NO: 800 - protein, 275 aa, Artificial Sequence
  Description of Artificial Sequence: Synthetic polypeptide
QSVVTQPPSVSGAPGQRVTISCTGSSSNIGAGYDVNWYQQFPGTAPKLLIYGNSNRPSGVPDRFSGSKSGTSASLAITGLQAEDEADYYCQSYDSSLSGSYVFGTGTKVTVLGSRGGGGSGGGGSGGGGSLEMAQMQLVQSGAEVKKPGASVKVSCKASGYTLTELSMHWVRQAPGKGLEWMGGFDPEDGETIYAQKFQGRVTMTEDTSTDTAYMELSSLRSEDTAVYYCARMSSMYYDWGQGTLVTVSSTSGQAGQHHHHHHGAYPYDVPDYAS

SEQ ID NO: 801 - DNA, 807 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgattatgtcttcggaactgggaccaaggtcaccgtcctaggttctagaggtggtggtggtagcggcggcggcggctctggtggtggtggatccctcgagatggccgaggtgcagctggtggagactgggggaggcttggtcaagcctggagggtccctgagactctcctgtgcagcctctggattcaccgtcagtgactactacatgagctggatccgccaggctccagggaagggcctggagtggatttcatacattagtggtagtggtaatagcatatactacgcagactctgtgaagggccgattcaccatctccagggacaacgccaagaactcactggatctgcaaatgaccagcctgagagccgaggacacggccgtatattactgtgcgcgctctactaaattcgattactggggtcaaggtactctggtgaccgtctcctcaactagtggccaggccggccagcaccatcaccatcaccatggcgcatacccgtacgacgttccggactacgcttct

SEQ ID NO: 802 - protein, 269 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDYVFGTGTKVTVLGSRGGGGSGGGGSGGGGSLEMAEVQLVETGGGLVKPGGSLRLSCAASGFTVSDYYMSWIRQAPGKGLEWISYISGSGNSIYYADSVKGRFTISRDNAKNSLDLQMTSLRAEDTAVYYCARSTKFDYWGQGTLVTVSSTSGQAGQHHHHHHGAYPYDVPDYAS

SEQ ID NO: 803 - DNA, 828 bp, Artificial Sequence
  Description of Artificial Sequence: Synthetic polynucleotide
ctgcctgtgctgactcagccaccctcagcgtctgggacccccgggcagagggtcaccatctcttgttctggaagcagctccaacgtcggaagttacactgtaaactggtaccggcaactcccaggaacggcccccacactcctcatctataataataatcagcggccctcaggggtccctgaccgattctctgactccaagtctggcacctcggcctccctgaccattagtgggctccagcctgaggatgaggctgattattattgtgcagcatgggatgacaggctgggtggttatgtcttcggaactgggaccaaggtcaccgtcctaggttctagaggtggtggtggtagcggcggcggcggctctggtggtggtggatccctcgagatggccgaggtgcagctggtgcagtctggagcagaggtgaaaaagccgggggagtctctgaagatctcctgtaagggttctggatacagctttaccaactactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctacagtggagcagcctgaaggcctcggacaccgccatgtattactgtgcgcgctctactggttcttctcatatgtctgatgaatggggtcaaggtactctggtgaccgtctcctcaactagtggccaggccggccagcaccatcaccatcaccatggcgcatacccgtacgacgttccggactacgcttct

SEQ ID NO: 804 - protein, 276 aa, Artificial Sequence
  Description of Artificial Sequence: Synthetic polypeptide
LPVLTQPPSASGTPGQRVTISCSGSSSNVGSYTVNWYRQLPGTAPTLLIYNNNQRPSGVPDRFSDSKSGTSASLTISGLQPEDEADYYCAAWDDRLGGYVFGTGTKVTVLGSRGGGGSGGGGSGGGGSLEMAEVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARSTGSSHMSDEWGQGTLVTVSSTSGQAGQHHHHHHGAYPYDVPDYAS

SEQ ID NO: 805 - DNA, 819 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcattgggtgttcggcggagggaccaagctgaccgtcctaggttctagaggtggtggtggtagcggcggcggcggctctggtggtggtggatccctcgagatggcccaagtgcagctacagcagtggggcgcaggactgttgaagccttcggagaccctgtccctcacctgcgctgtctatggtgggtccttcagtggttactactggagctggatccgccagcccccagggaaggggctggagtggattggggagatcactcatagtggaaggtccaactacaacccgtccctcaagagtcgagtcaccatatcagtagacacgtccaagaaccagttctccctgaagctgagctctgtgaccgccgcggacacggccgtgtattactgtgcgcgctcttctatcatgtctgattactggggtcaaggtactctggtgaccgtctcctcaactagtggccaggccggccagcaccatcaccatcaccatggcgcatacccgtacgacgttccggactacgcttct

SEQ ID NO: 806 - protein, 273 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVLGSRGGGGSGGGGSGGGGSLEMAQVQLQQWGAGLLKPSETLSLTCAVYGGSFSGYYWSWIRQPPGKGLEWIGEITHSGRSNYNPSLKSRVTISVDTSKNQFSLKLSSVTAADTAVYYCARSSIMSDYWGQGTLVTVSSTSGQAGQHHHHHHGAYPYDVPDYAS

SEQ ID NO: 807 - DNA, 828 bp, Artificial Sequence
  Description of Artificial Sequence: Synthetic polynucleotide
cagtctgtgttgacgcagccgccctcagtgtctggggccccagggcagagggtcaccatctcctgcactgggagcacctccaacatcggggcaggttatgatgtacactggtaccagcagcttccaggaacagcccccaaactcctcatcaacaataacaggaatcggccctcaggggtccctgaccgattctctggctccaagtctggcacgtcagccaccctgggcatcaccggactccagactggggacgaggccgattattactgcggaacatgggatggcagcctgactggtgcagtgttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcatgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgcggttctgctctggaccattacgatcgttggggtcaaggtactctggtgaccgtctcctcaactagtggccaggccggccagcaccatcaccatcaccatggcgcatacccgtacgacgttccggactacgcttct

SEQ ID NO: 808 - protein, 276 aa, Artificial Sequence
  Description of Artificial Sequence: Synthetic polypeptide
QSVLTQPPSVSGAPGQRVTISCTGSTSNIGAGYDVHWYQQLPGTAPKLLINNNRNRPSGVPDRFSGSKSGTSATLGITGLQTGDEADYYCGTWDGSLTGAVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGSALDHYDRWGQGTLVTVSSTSGQAGQHHHHHHGAYPYDVPDYAS

SEQ ID NO: 809 - DNA, 822 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaccaattgggtgttcggcggagggaccaagctgaccgtcctaggttctagaggtggtggtggtagcggcggcggcggctctggtggtggtggatccctcgagatggcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgctacaactactacttcaacgattactggggtcaaggtactctggtgaccgtctcctcaactagtggccaggccggccagcaccatcaccatcaccatggcgcatacccgtacgacgttccggactacgcttct

SEQ ID NO: 810 - protein, 274 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSTNWVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYFNDYWGQGTLVTVSSTSGQAGQHHHHHHGAYPYDVPDYAS

SEQ ID NO: 811 - DNA, 819 bp, Artificial Sequence
  Description of Artificial Sequence: Synthetic polynucleotide
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggttctagaggtggtggtggtagcggcggcggcggctctggtggtggtggatccctcgagatggcccagatgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacactgccgtgtattactgtgcgcgctctatgttcggtgctcatgattcttggggtcaaggtactctggtgaccgtctcctcaactagtggccaggccggccagcaccatcaccatcaccatggcgcatacccgtacgacgttccggactacgcttct

SEQ ID NO: 812 - protein, 273 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPYVFGTGTKVTVLGSRGGGGSGGGGSGGGGSLEMAQMQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSMFGAHDSWGQGTLVTVSSTSGQAGQHHHHHHGAYPYDVPDYAS

SEQ ID NO: 813 - DNA, 828 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacatcggggcaggttttgatgtacactggtaccagctacttccaggaacagcccccaaactcctcatctatgctaacagcaatcggccctcaggggtccctgaccgattctctggctccaagtctggcacctcagcctccctggccatcactgggctcctggctgaggatgaggctgattattactgccagtcctatgacagcagcctgagtggtgtggtattcggcggagggaccaagctgaccgtcctaggttctagaggtggtggtggtagcggcggcggcggctctggtggtggtggatccctcgagatggcccaggtgcagctggtgcaatctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacactgccgtgtattactgtgcgcgcggtgcttctttcgaccgtcatgataactggggtcaaggtactctggtgaccgtctcctcaactagtggccaggccggccagcaccatcaccatcaccatggcgcatacccgtacgacgttccggactacgcttct

SEQ ID NO: 814 - protein, 276 aa, Artificial Sequence
  Description of Artificial Sequence: Synthetic polypeptide
QSVLTQPPSVSGAPGQRVTISCTGSSSNIGAGFDVHWYQLLPGTAPKLLIYANSNRPSGVPDRFSGSKSGTSASLAITGLLAEDEADYYCQSYDSSLSGVVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGASFDRHDNWGQGTLVTVSSTSGQAGQHHHHHHGAYPYDVPDYAS

SEQ ID NO: 815 - DNA, 822 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgctctaactactactacaacgattactggggtcaaggtactctggtgaccgtctcctcaactagtggccaggccggccagcaccatcaccatcaccatggcgcatacccgtacgacgttccggactacgcttct

SEQ ID NO: 816 - protein, 274 aa, Artificial Sequence
  Description of Artificial Sequence: Synthetic polypeptide
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSNYYYNDYWGQGTLVTVSSTSGQAGQHHHHHHGAYPYDVPDYAS

SEQ ID NO: 817 - DNA, 822 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtcctaggttctagaggtggtggtggtagcggcggcggcggctctggtggtggtggatccctcgagatggcccaggtgcagctggtgcagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacactgccgtgtattactgtgcgcgctactctggtgtttactacgattggggtcaaggtactctggtgaccgtctcctcaactagtggccaggccggccagcaccatcaccatcaccatggcgcatacccgtacgacgttccggactacgcttct

SEQ ID NO: 818 - protein, 274 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLGSRGGGGSGGGGSGGGGSLEMAQVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCARYSGVYYDWGQGTLVTVSSTSGQAGQHHHHHHGAYPYDVPDYAS

SEQ ID NO: 819 - DNA, 822 bp, Artificial Sequence
  Description of Artificial Sequence: Synthetic polynucleotide
aattttatgctgactcagccccactctgtgtcggggtctccggggaagacggtaaccatctcctgcaccggcagcagtggcagcattgccgacaactttgtgcagtggtaccagcagcgcccgggcggtgtccccaccactgtgatctttaatgatgacgaaagaccctctggcgtccctgatcggttctctggctccatcgacacctcctccaattctgcctccctcaccatctctggactgaagactgaggacgaggctgactactactgtcagtcttatgataataataatcgaggggtgttcggcggagggaccaagctgaccgtcctaggttctagaggtggtggtggtagcggcggcggcggctctggtggtggtggatccctcgagatggcccaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatgaaccctaacagtggtaacacaggctatgcacagaagttccagggcagagtcaccatgaccaggaacacctccataagcacagcctacatggagctgagcaacctgagatctgaggacacggccgtgtattactgtgcgcgctactactcttacggttacgattggggtcaaggtactctggtgaccgtctcctcaactagtggccaggccggccagcaccatcaccatcaccatggcgcatacccgtacgacgttccggactacgcttct

SEQ ID NO: 820 - protein, 274 aa, Artificial Sequence
  Description of Artificial Sequence: Synthetic polypeptide
NFMLTQPHSVSGSPGKTVTISCTGSSGSIADNFVQWYQQRPGGVPTTVIFNDDERPSGVPDRFSGSIDTSSNSASLTISGLKTEDEADYYCQSYDNNNRGVFGGGTKLTVLGSRGGGGSGGGGSGGGGSLEMAQVQLVQSGAEVKKPGSSVKVSCKASGGTFSSYAISWVRQAPGQGLEWMGWMNPNSGNTGYAQKFQGRVTMTRNTSISTAYMELSNLRSEDTAVYYCARYYSYGYDWGQGTLVTVSSTSGQAGQHHHHHHGAYPYDVPDYAS

SEQ ID NO: 821 - DNA, 840 bp, Artificial Sequence
  Description of Artificial Sequence: Synthetic polynucleotide
cagtctgtcgtgacgcagccgccctcagtgtctggggccccagggcagacggtcaccatctcctgcactgggggcagctccaacatcgggacaggttattttgtaaattggtaccagcaggttccaggaaaagcccccaaactcctcatcctgggtaacaataatcggccctcgggggtccctgaccgactctccggctccacgtccggcacctcagcctccctggccatcactgggctccaggctgaggatgagggtacttattactgccagtcctatgacagcagcctgagtggttatgtcttcggaactgggaccaaggtcaccgtcctaggttctagaggtggtggtggtagcggcggcggcggctctggtggtggtggatccctcgagatggcccaggtacagctgcagcagtcaggtccaggactggtgaagccctcgcagaccctctcactcacctgtggcatctccggggacagtgtctctaccaacagtgttgcttggcactggatcaggcagtccccatcgagaggccttgagtggctgggaaggacatactacaggtccaagtggtctaatgactatggagtatctgtgaaaagtcgaatcaccatcatcccagacacatccaagaaccagttctccctgcagctgaactctgtgactcccgaggacacggctgtgtattactgtgcgcgctcttcttcttggtaccagatcttcgattactggggtcaaggtactctggtgaccgtctcctcaactagtggccaggccggccagcaccatcaccatcaccatggcgcatacccgtacgacgttccggactacgcttct

SEQ ID NO: 822 - protein, 280 aa, Artificial Sequence
  Description of Artificial Sequence: Synthetic polypeptide
QSVVTQPPSVSGAPGQTVTISCTGGSSNIGTGYFVNWYQQVPGKAPKLLILGNNNRPSGVPDRLSGSTSGTSASLAITGLQAEDEGTYYCQSYDSSLSGYVFGTGTKVTVLGSRGGGGSGGGGSGGGGSLEMAQVQLQQSGPGLVKPSQTLSLTCGISGDSVSTNSVAWHWIRQSPSRGLEWLGRTYYRSKWSNDYGVSVKSRITIIPDTSKNQFSLQLNSVTPEDTAVYYCARSSSWYQIFDYWGQGTLVTVSSTSGQAGQHHHHHHGAYPYDVPDYAS

SEQ ID NO: 823 - DNA, 837 bp, Artificial Sequence
  Description of Artificial Sequence: Synthetic polynucleotide
aattttatgctgactcagccccactctgtgtcggagtctccggggaagacggtaaccatctcctgcaccggcagcagcgacagcatagccaacaactatgttcagtggtaccagcagcgcccgggcagtgcccccaccaatgtgatctacgaagatgtccaaagaccctctggggtccctgatcggttctctgggtccatcgacagctcctccaactctgcctccctcaccatctctggactgaagactgaggacgaggctgtctactattgtcagtcttatcatagcgacaatcgttgggtgttcggcggcgggaccaagctgaccgtcctaggttctagaggtggtggtggtagcggcggcggcggctctggtggtggtggatccctcgagatggcccaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgcgctctggtgcttactgggactactctgtttacgatgaatggggtcaaggtactctggtgaccgtctcctcaactagtggccaggccggccagcaccatcaccatcaccatggcgcatacccgtacgacgttccggactacgcttct

SEQ ID NO: 824 - protein, 279 aa, Artificial Sequence
  Description of Artificial Sequence: Synthetic polypeptide
NFMLTQPHSVSESPGKTVTISCTGSSDSIANNYVQWYQQRPGSAPTNVIYEDVQRPSGVPDRFSGSIDSSSNSASLTISGLKTEDEAVYYCQSYHSDNRWVFGGGTKLTVLGSRGGGGSGGGGSGGGGSLEMAQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARSGAYWDYSVYDEWGQGTLVTVSSTSGQAGQHHHHHHGAYPYDVPDYAS

SEQ ID NO: 825 - DNA, 819 bp, Artificial Sequence
  Description of Artificial Sequence: Synthetic polynucleotide
cagtctgtgttgactcagccaccctcagtgtccgtgtccccaggacagacagccaccatcgcctgttctggacataaattgggggataaatatgcttcctggtatcagcagaagtcgggccagtcccctgtgttgatcatctatcaggataataagcggccctcagggattcctgagcgattctctggctccaactctgggaacacagccactctgaccatcagcgggacccaggctctggatgaggctgactattattgtcaggcgtgggacagtagtacttatgtggcattcggcggagggaccaagctgaccgtcctaggttctagaggtggtggtggtagcggcggcggcggctctggtggtggtggatccctcgagatggcccaggtgcagctgcaggagtccggcccaggactggtgaagccttcggagaccctgtccctcacctgcgttgtctctggtggctccatcagcagtagtaactggtggagctgggtccgccagcccccagggaaggggctggagtggattggggaaatctatcatagtgggagccccaactacaacccatccctcaagagtcgagtcaccatatcagtagacaagtccaagaaccagttctccctgaagctgagctctgtgaccgccgcggacacggccgtgtattactgtgcgcgcatgactactcatactttcggttacgatgcttggggtcaaggtactctggtgaccgtctcctcaactagtggccaggccggccagcaccatcaccatcaccatggcgcatacccgtacgacgttccggactacgcttct

SEQ ID NO: 826 - protein, 273 aa, Artificial Sequence
  Description of Artificial Sequence: Synthetic polypeptide
QSVLTQPPSVSVSPGQTATIACSGHKLGDKYASWYQQKSGQSPVLIIYQDNKRPSGIPERFSGSNSGNTATLTISGTQALDEADYYCQAWDSSTYVAFGGGTKLTVLGSRGGGGSGGGGSGGGGSLEMAQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARMTTHTFGYDAWGQGTLVTVSSTSGQAGQHHHHHHGAYPYDVPDYAS

SEQ ID NO: 827 - DNA, 810 bp, Artificial Sequence
  Description of Artificial Sequence: Synthetic polynucleotide
cagcctgtgctgactcagccaccctcagtgtcagtggccccaggaaagacggccacgattacttgtgggggaaacaacattggaagtgaaagtgtgcactggtaccaccagaagccaggccaggcccctgtgttggtcatctatgatgatgccggccggccctcagggatccctgagcgattcactggctccaactctgggaacacggccaccctgaccatcagcagggtcgaagccggggatgaggccgactattactgtcaggtgtgggacagaaatagtgctcagtttgtcttcggacctgggaccaaggtcaccgtcctaggttctagaggtggtggtggtagcggcggcggcggctctggtggtggtggatccctcgagatggccgaggtccagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgcgcggtgttcatctggattggtggggtcaaggtactctggtgaccgtctcctcaactagtggccaggccggccagcaccatcaccatcaccatggcgcatacccgtacgacgttccggactacgcttct

SEQ ID NO: 828 - protein, 270 aa, Artificial Sequence
  Description of Artificial Sequence: Synthetic polypeptide
QPVLTQPPSVSVAPGKTATITCGGNNIGSESVHWYHQKPGQAPVLVIYDDAGRPSGIPERFTGSNSGNTATLTISRVEAGDEADYYCQVWDRNSAQFVFGPGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGVHLDWWGQGTLVTVSSTSGQAGQHHHHHHGAYPYDVPDYAS

SEQ ID NO: 829 - DNA, 846 bp, Artificial Sequence
  Description of Artificial Sequence: Synthetic polynucleotide
cagtctgtcgtgacgcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggttatgtcttcggaactgggaccaagctgaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgcctgtacgaaggtggttaccatggttggggttcttggctgtcttctgattcttggggtcaaggtactctggtgaccgtctcctcaactagtggccaggccggccagcaccatcaccatcaccatggcgcatacccgtacgacgttccggactacgcttct

SEQ ID NO: 830 - protein, 282 aa, Artificial Sequence
  Description of Artificial Sequence: Synthetic polypeptide
QSVVTQPPSASGTPGQRVTISCSGSSSNIGSNYVYWYQQLPGTAPKLLIYSNNQRPSGVPDRFSGSKSGTSASLAISGLRSEDEADYYCAAWDDSLSGYVFGTGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLYEGGYHGWGSWLSSDSWGQGTLVTVSSTSGQAGQHHHHHHGAYPYDVPDYAS

SEQ ID NO: 831 - DNA, 825 bp, Artificial Sequence
  Description of Artificial Sequence: Synthetic polynucleotide
cagtctgtgttgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttattgggtgttcggcggagggaccaagctgaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgcgcgaaggggcatttgatgcttttgatatctggggccaagggacaatggtcaccgtctcttcaactagtggccaggccggccagcaccatcaccatcaccatggcgcatacccgtacgacgttccggactacgcttct

SEQ ID NO: 832 - protein, 275 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYWVFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGAFDAFDIWGQGTMVTVSSTSGQAGQHHHHHHGAYPYDVPDYAS

SEQ ID NO: 833 - DNA, 831 bp, Artificial Sequence
  Description of Artificial Sequence: Synthetic polynucleotide
tcctatgagctgactcagccaccctcagcgtctgggacccccgggcagagggtcaccatctcttgttctggaagcagctccaacatcggaagtaattatgtatactggtaccagcagctcccaggaacggcccccaaactcttcatctataggaataatcagcggccctcaggggtccctgaccgattctctggctccaagtctggcacctcagcctccctggccatcagtgggctccggtccgaggatgaggctgattattactgtgcagcatgggatgacagcctgagtggttatctcttcggaactgggaccaaggtcaccgtcctaggttctagaggtggtggtggtagcggcggcggcggctctggtggtggtggatccctcgagatggccgaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaatggcgactccaactactactacggtatggacgtctggggccaagggaccacggtcaccgtctcctcaactagtggccaggccggccagcaccatcaccatcaccatggcgcatacccgtacgacgttccggactacgcttct

SEQ ID NO: 834 - protein, 277 aa, Artificial Sequence
  Description of Artificial Sequence: Synthetic polypeptide
SYELTQPPSASGTPGQRVTISCSGSSSNIGSNYVYWYQQLPGTAPKLFIYRNNQRPSGVPDRFSGSKSGTSASLAISGLRSEDEADYYCAAWDDSLSGYLFGTGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCANGDSNYYYGMDVWGQGTTVTVSSTSGQAGQHHHHHHGAYPYDVPDYAS

SEQ ID NO: 835 - DNA, 843 bp, Artificial Sequence
  Description of Artificial Sequence: Synthetic polynucleotide
cagtctgccctgactcagcctgcctccgtgtccgggtctcctggacagtcgatcaccatctcctgcactggaaccagcagtgacattggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcatctcatatacacgcacctggaacccctatgtcttcgggagtgggaccaaggtcaccgtcctaggttctagaggtggtggtggtagcggcggcggcggctctggtggtggtggatccctcgagatggccgaggtgcagctggtgcagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaagatcgggcagcagctggctactactactacggtatggacgtctggggccaagggaccacggtcaccgtctcctcaactagtggccaggccggccagcaccatcaccatcaccatggcgcatacccgtacgacgttccggactacgcttct

SEQ ID NO: 836 - protein, 281 aa, Artificial Sequence
  Description of Artificial Sequence: Synthetic polypeptide
QSALTQPASVSGSPGQSITISCTGTSSDIGGYNYVSWYQQHPGKAPKLMIYDVSNRPSGVSNRFSGSKSGNTASLTISGLQAEDEADYYCISYTRTWNPYVFGSGTKVTVLGSRGGGGSGGGGSGGGGSLEMAEVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDRAAAGYYYYGMDVWGQGTTVTVSSTSGQAGQHHHHHHGAYPYDVPDYAS

SEQ ID NO: 837 - DNA, 825 bp, Artificial Sequence
  Description of Artificial Sequence: Synthetic polynucleotide
ctgcctgtgctgactcagccaccctcagtgtccgtgtccccaggacagacagccatcatcacctgctctggagataaattgggggaaaaatatgtttcctggtatcagcagaagccaggccagtcccctgtactggtcatcgatcaagataccaggaggccctcagggatccctgagcgattctctggctccaactctgggaccacagccactctgaccatcagcgggacccaggctatggatgaggctgactattactgtcaggcgtgggacaggggtgtggtattcggcggagggaccaagctgaccgtcctaggttctagaggtggtggtggtagcggcggcggcggctctggtggtggtggatccctcgagatggccgaggtgcagctggtggagtctgggggagacttggtacagcctggcaggtccctgagactctcctgtgcagcctctggattcacctttaatgattatgccatgcactgggtccggcaagctccagggaagggcctggagtgggtctcaggtattagttggagtggtaataacataggctatgcggactctgtgaagggccgattcaccatctccagagacaacgccaagaactccctgtatctgcaaatgaacagtctgagagctgaggacacggccttgtattactgtgcaaaagatagtatacggtatggcatcacctggggaggttttgactactggggccagggaaccctggtcaccgtctcctcaactagtggccaggccggccagcaccatcaccatcaccatggcgcatacccgtacgacgttccggactacgcttct

SEQ ID NO: 838 - protein, 275 aa, Artificial Sequence
  Description of Artificial Sequence: Synthetic polypeptide
LPVLTQPPSVSVSPGQTAIITCSGDKLGEKYVSWYQQKPGQSPVLVIDQDTRRPSGIPERFSGSNSGTTATLTISGTQAMDEADYYCQAWDRGVVFGGGTKLTVLGSRGGGGSGGGGSGGGGSLEMAEVQLVESGGDLVQPGRSLRLSCAASGFTFNDYAMHWVRQAPGKGLEWVSGISWSGNNIGYADSVKGRFTISRDNAKNSLYLQMNSLRAEDTALYYCAKDSIRYGITWGGFDYWGQGTLVTVSSTSGQAGQHHHHHHGAYPYDVPDYAS

SEQ ID NO: 839 - DNA, 825 bp, Artificial Sequence
  Description of Artificial Sequence: Synthetic polynucleotide
cagcctgtgctgactcagccaccctcggtgtccaagggcttgagacagaccgccacactcacctgcactgggaacagcaacaatgttggcaacctaggagtagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagtagcctcagtgcttgggtgttcggcggagggaccaagctgaccgtcctaggttctagaggtggtggtggtagcggcggcggcggctctggtggtggtggatccctcgagatggccgaggtgcagctggtggagtctgggggagtcgtggtacagcctggggggtccctgagactctcctgtgcagcctctggattcacctttgatgattatgccatgcactgggtccgtcaagctccggggaagggtctggagtgggtctctcttattaattgggatggtggtagcacctactatgcagactctgtgaagggtcgattcaccatctccagagacaacagcaaaaactccctgtatctgcaaatgaacagtctgagagctgaggacaccgccttgtattactgtgcaaaagggatgggcctgagggcgtttgactactggggccagggaaccctggtcaccgtctcctcaactagtggccaggccggccagcaccatcaccatcaccatggcgcatacccgtacgacgttccggactacgcttct

SEQ ID NO: 840 - protein, 275 aa, Artificial Sequence
  Description of Artificial Sequence: Synthetic polypeptide
QPVLTQPPSVSKGLRQTATLTCTGNSNNVGNLGVAWLQQHQGHPPKLLSYRNNNRPSGISERLSASRSGNTASLTITGLQPEDEADYYCSAWDSSLSAWVFGGGTKLTVLGSRGGGGSGGGGSGGGGSLEMAEVQLVESGGVVVQPGGSLRLSCAASGFTFDDYAMHWVRQAPGKGLEWVSLINWDGGSTYYADSVKGRFTISRDNSKNSLYLQMNSLRAEDTALYYCAKGMGLRAFDYWGQGTLVTVSSTSGQAGQHHHHHHGAYPYDVPDYAS

SEQ ID NO: 841 - DNA, 840 bp, Artificial Sequence
  Description of Artificial Sequence: Synthetic polynucleotide
cagtctgtgttgactcagccaccctcagcgtctgggacccccgggcagagggtcaccatctcctgttctggaagcagctccaacatcggaagtaatactgtaaactggtaccagcagctcccaggaacggcccccaaactcctcatctatagtaatgatcagcggccctcaggggtccctgaccgattctctggctccaagtccggcacctcagcctccctggccatcagtgggctccagtctgaggatgaggctgattattactgtgcttcatgggatgacagcctgaatggccgttatgtcttcggaactgggaccaaggtcaccgtcctaggttctagaggtggtggtggtagcggcggcggcggctctggtggtggtggatccctcgagatggcccaggtccagctggtacagtctggggctgaggtgaggaagcctggggcctcagtgaaggtttcctgcaagacttctggatacaccttcagttggtatgctatacattgggtgcgccaggcccccggacaaaggcttgagtggatgggatggatcaacgctggcaatggaaacacaaaatattcacagaaatttcagggcagagtcagtcttaccagggacacatccgcgagcacagcctacatggagctgagcagcctgagatctgatgacacggctgtgtattactgtgcgagacccgataattatggttcgggtggggatgtttttgatatctggggccaagggacaatggtcaccgtctcttcaactagtggccaggccggccagcaccatcaccatcaccatggcgcatacccgtacgacgttccggactacgcttct

SEQ ID NO: 842 - protein, 280 aa, Artificial Sequence
  Description of Artificial Sequence: Synthetic polypeptide
QSVLTQPPSASGTPGQRVTISCSGSSSNIGSNTVNWYQQLPGTAPKLLIYSNDQRPSGVPDRFSGSKSGTSASLAISGLQSEDEADYYCASWDDSLNGRYVFGTGTKVTVLGSRGGGGSGGGGSGGGGSLEMAQVQLVQSGAEVRKPGASVKVSCKTSGYTFSWYAIHWVRQAPGQRLEWMGWINAGNGNTKYSQKFQGRVSLTRDTSASTAYMELSSLRSDDTAVYYCARPDNYGSGGDVFDIWGQGTMVTVSSTSGQAGQHHHHHHGAYPYDVPDYAS

SEQ ID NO: 843 - DNA, 819 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactttgtgcagtggtaccagcagcgcccgggcagtgcccccacccctatgatctatgaggataacaacagaccccctggggtccctgatcggttctctgcctccgtcgacagctcctccaactctgcctccctcaccatctctggactgaagactgaggacgaggctgactactactgtcagtcttatgataccagcaatgtggtattcggcggggggaccaagctgaccgtcctaggttctagaggtggtggtggtagcggcggcggcggctctggtggtggtggatccctcgagatggccgaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcacgctgggactacggtatggacgtctggggccaagggaccacggtcaccgtctcctcaactagtggccaggccggccagcaccatcaccatcaccatggcgcatacccgtacgacgttccggactacgcttct

SEQ ID NO: 844 - protein, 273 aa, Artificial Sequence
  Description of Artificial Sequence: Synthetic polypeptide
NFMLTQPHSVSESPGKTVTISCTRSSGSIASNFVQWYQQRPGSAPTPMIYEDNNRPPGVPDRFSASVDSSSNSASLTISGLKTEDEADYYCQSYDTSNVVFGGGTKLTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSSTSGQAGQHHHHHHGAYPYDVPDYAS

SEQ ID NO: 845 - DNA, 837 bp, Artificial Sequence
  Description of Artificial Sequence: Synthetic polynucleotide
caggctgtgctgactcagccaccctcagcgtctggggcccccgggcagagggtcaccgtctcttgttctggaagcaactccaacatcggaagtaactacgttaactggtaccagcagttcccaggaacggcccccaaactcctcatgtatagtagtagtcagcggccctcaggggtccctgaccgattctctggctccaagtctggcacctcagcctccctggccatcagtgggctccactctgaggatgaggctgattattactgtgctacatgggatgacagcctgaatgcttgggtgttcggcggagggaccaagctgaccgtcctaggttctagaggtggtggtggtagcggcggcggcggctctggtggtggtggatccctcgagatggccgaggtccagctggtgcagtctggggctgaggtgaggaagcctggggcctcagtgaaggtttcctgcaagacttctggatacaccttcacttggtatgctatacattgggtgcgccaggcccccggacaaaggcttgagtggatgggatggatcaacgctggcagtggaaacacaaaatattcacagaaatttcagggcagagtcacccttaccagggacacatccgcgagcacagcgtacatggagctgagcagcctgagatctgatgacacggctgtgtattactgtgcgagacccaataactatggttcgggtggggatgtttttgatatctggggccaagggacaatggtcaccgtctcttcaactagtggccaggccggccagcaccatcaccatcaccatggcgcatacccgtacgacgttccggactacgcttct

SEQ ID NO: 846 - protein, 279 aa, Artificial Sequence
  Description of Artificial Sequence: Synthetic polypeptide
QAVLTQPPSASGAPGQRVTVSCSGSNSNIGSNYVNWYQQFPGTAPKLLMYSSSQRPSGVPDRFSGSKSGTSASLAISGLHSEDEADYYCATWDDSLNAWVFGGGTKLTVLGSRGGGGSGGGGSGGGGSLEMAEVQLVQSGAEVRKPGASVKVSCKTSGYTFTWYAIHWVRQAPGQRLEWMGWINAGSGNTKYSQKFQGRVTLTRDTSASTAYMELSSLRSDDTAVYYCARPNNYGSGGDVFDIWGQGTMVTVSSTSGQAGQHHHHHHGAYPYDVPDYAS

SEQ ID NO: 847 - DNA, 834 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgcttatgtcttcggaactgggaccaaggtcaccgtcctaggttctagaggtggtggtggtagcggcggcggcggctctggtggtggtggatccctcgagatggcccaggtccagctggtgcagtctggggctgaggtgaagaagcctggggcctcagtgaaagtttcctgcaaggcttctggatacaccttcacgaactatgctctgcattgggtgcgccaggcccccggacaagggcttgagtggatggcatggatcaacggtggcaatggtaacacaaaatattcacagaacttccagggcagagtcaccattaccagggacacatccgcgagcacagcctatatggagctgagcagcctgagatctgaagacacggctgtgtattactgtgcgaaaccggaggaaacagctggaacaatccactttgactactggggccagggaaccccggtcaccgtctcctcaactagtggccaggccggccagcaccatcaccatcaccatggcgcatacccgtacgacgttccggactacgcttct

SEQ ID NO: 848 - protein, 278 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLGSRGGGGSGGGGSGGGGSLEMAQVQLVQSGAEVKKPGASVKVSCKASGYTFTNYALHWVRQAPGQGLEWMAWINGGNGNTKYSQNFQGRVTITRDTSASTAYMELSSLRSEDTAVYYCAKPEETAGTIHFDYWGQGTPVTVSSTSGQAGQHHHHHHGAYPYDVPDYAS

SEQ ID NO: 849 - DNA, 849 bp, Artificial Sequence
  Description of Artificial Sequence: Synthetic polynucleotide
caggctgtgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaccatcacggtgttcggcggagggaccaagctgaccgtcctaggttctagaggtggtggtggtagcggcggcggcggctctggtggtggtggatccctcgagatggcccaggtccagctggtacagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgggggagggttactatgatagtagtggttattccaacggtgatgcttttgatatctggggccaagggacaatggtcaccgtctcttcaactagtggccaggccggccagcaccatcaccatcaccatggcgcatacccgtacgacgttccggactacgcttct

SEQ ID NO: 850 - protein, 283 aa, Artificial Sequence
  Description of Artificial Sequence: Synthetic polypeptide
QAVLTQPHSVSESPGKTVTISCTRSSGSIASNYVQWYQQRPGSAPTTVIYEDNQRPSGVPDRFSGSIDSSSNSASLTISGLKTEDEADYYCQSYDSTITVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCAGEGYYDSSGYSNGDAFDIWGQGTMVTVSSTSGQAGQHHHHHHGAYPYDVPDYAS

SEQ ID NO: 851 - DNA, 819 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatgtggtattcggcggagggaccaaggtcaccgtcctaggttctagaggtggtggtggtagcggcggcggcggctctggtggtggtggatccctcgagatggccgaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcacgctgggactacggtatggacgtctggggccaagggaccacggtcaccgtctcctcaactagtggccaggccggccagcaccatcaccatcaccatggcgcatacccgtacgacgttccggactacgcttct

SEQ ID NO: 852 - protein, 273 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNVVFGGGTKVTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSSTSGQAGQHHHHHHGAYPYDVPDYAS

SEQ ID NO: 853 - DNA, 828 bp, Artificial Sequence
  Description of Artificial Sequence: Synthetic polynucleotide
tcctatgtgctgactcagccaccctcagtgtccgtgtccccaggacagacagccagcatcacctgctctggagatagattgacgaataaatatgtttcctggtatcaacagaagccaggccagtcccctgtgttggtcatctatgaggatgccaagcggccctcagggatccctgcgcgattctctggctccaactctgggaacacagccactctgaccatcagcgggacccaggctatggatgagtctgaatattactgtcaggcgtgggacagcagtgtggtggtttttggcggagggaccaagctgaccgtcctaggttctagaggtggtggtggtagcggcggcggcggctctggtggtggtggatccctcgagatggccgaggtgcagctggtggagtctgggggaggcttggtacagcctggcaggtccctgagactctcctgtgcagcctctggatttacctttgatgattatgccatgcactgggtccggcaagctccagggaagggcctggagtgggtctcaggtattagttggaatagtggtagtataggctatgcggactctgtgaagggccgattcaccatctccagagacaacgccaagaactccctgtatctgcaaatgaacagtctgagagatgaggacacggccttgtattactgtgcaaaagaccgaggggggggagttatcgttaaggatgcttttgatatctggggccaagggacaatggtcaccgtctcttcaactagtggccaggccggccagcaccatcaccatcaccatggcgcatacccgtacgacgttccggactacgcttct

SEQ ID NO: 854 - protein, 276 aa, Artificial Sequence
  Description of Artificial Sequence: Synthetic polypeptide
SYVLTQPPSVSVSPGQTASITCSGDRLTNKYVSWYQQKPGQSPVLVIYEDAKRPSGIPARFSGSNSGNTATLTISGTQAMDESEYYCQAWDSSVVVFGGGTKLTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRDEDTALYYCAKDRGGGVIVKDAFDIWGQGTMVTVSSTSGQAGQHHHHHHGAYPYDVPDYAS

SEQ ID NO: 855 - DNA, 825 bp, Artificial Sequence
  Description of Artificial Sequence: Synthetic polynucleotide
tcctatgagctgactcagccacccgcagcgtctgggacccccggacagagagtcaccatctcttgttctgggggcgtctccaacatcgggagtggtgctctaaattggtaccagcaactcccaggaacggcccccaaactcctcatctatagttacaatcagcggccctcaggggtctctgaccgattctctggctccaggtctgccacctcagcctccctggccatcagtgggctccagtctgaggatgaggctgattattactgtgcaacctgggatgatagtgtgaatggttgggtgttcggcggagggaccaagctgaccgtcctaggttctagaggtggtggtggtagcggcggcggcggctctggtggtggtggatccctcgagatggccgaggtgcagctggtggagtctggagctgaggtgaagaagcctggggattcagtgaaggtctcctgcaagccttctggttacaattttctcaactatggtatcaactgggtgcgacaggcccctggacaagggcttgagtggatgggatggattagcacttacaccggtaacacaaactatgcacagaagctgcagggcagagtcaccttcaccacagacacatccacgagcacagcctacatggagatgaggagcctgagatctgacgacacggccgtgtattactgtgcgcgccagcagggtggtggttggtacgatgtttggggtcaaggtactctggtcaccgtctcctcaactagtggccaggccggccagcaccatcaccatcaccatggcgcatacccgtacgacgttccggactacgcttct

SEQ ID NO: 856 - protein, 275 aa, Artificial Sequence
  Description of Artificial Sequence: Synthetic polypeptide
SYELTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAEVQLVESGAEVKKPGDSVKVSCKPSGYNFLNYGINWVRQAPGQGLEWMGWISTYTGNTNYAQKLQGRVTFTTDTSTSTAYMEMRSLRSDDTAVYYCARQQGGGWYDVWGQGTLVTVSSTSGQAGQHHHHHHGAYPYDVPDYAS

SEQ ID NO: 857 - DNA, 843 bp, Artificial Sequence
  Description of Artificial Sequence: Synthetic polynucleotide
cagtctgtcgtgacgcagccgccctcagtgtctgcggccccaggagagaaggtcaccatctcctgctctggaagcaacttcaatgttggaaataatgatgtatcctggtatcagcaactcccaggtgcagcccccaaactcctcatttatgacaataataagcgaccctcagggattcctgaccgattctctggctccaagtctggcacgtcagccaccctggacatcaccgggctccacagtgacgacgaggccgattattactgcggaacatgggatagcagcctgaatactgggggggtcttcggaactgggaccaaggtcaccgtcctaggttctagaggtggtggtggtagcggcggcggcggctctggtggtggtggatccctcgagatggccgaggtccagctggtgcagtctggagctgaggtgaagaagcctggggcctcagtgaaggtctcctgcaaggcttctggttacacctttaccagctatactatcagctgggtacgacaggcccctggacaagggcttgagtggatgggatggatcagcacttacaatggtctcacaaactatgcacagaacctccagggcagagtcaccatgactacagacacattcacgaccacagcctacatggagctgaggagcctcagatctgacgacacggccgtgtattactgtgtgagagaggggtcccccgactacggtgacttcgcgtcctttgactactggggccagggaaccctggtcaccgtctcctcaactagtggccaggccggccagcaccatcaccatcaccatggcgcatacccgtacgacgttccggactacgcttct

SEQ ID NO: 858 - protein, 281 aa, Artificial Sequence
  Description of Artificial Sequence: Synthetic polypeptide
QSVVTQPPSVSAAPGEKVTISCSGSNFNVGNNDVSWYQQLPGAAPKLLIYDNNKRPSGIPDRFSGSKSGTSATLDITGLHSDDEADYYCGTWDSSLNTGGVFGTGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSSTSGQAGQHHHHHHGAYPYDVPDYAS

SEQ ID NO: 859 - DNA, 843 bp, Artificial Sequence
  Description of Artificial Sequence: Synthetic polynucleotide
cagtctgtgttgacgcagccgccctcagtgtctgcgcccccgggacagaaggtcaccatctcctgctctggaagcagctccaacattgggaataattatgtatcctggtaccagcagttcccaggaacagcccccaaactcctcatttatgacaataataagcgaccctcagggatttctgaccgattctctggctccaagtctggcacgtcagccaccctgggcatcgccggactccagactggggacgaggccgattattactgcggaacatgggataccagcctgagtggtttttatgtcttcggaagtgggaccaaggtcaccgtcctaggttctagaggtggtggtggtagcggcggcggcggctctggtggtggtggatccctcgagatggccgaggtccagctggtacagtctggagctgaggtgaagaagcctggggcctcagtgaaggtctcctgcaaggcttctggttacacctttaccagctatactatcagctgggtacgacaggcccctggacaagggcttgagtggatgggatggatcagcacttacaatggtctcacaaactatgcacagaacctccagggcagagtcaccatgactacagacacattcacgaccacagcctacatggagctgaggagcctcagatctgacgacacggccgtgtattactgtgtgagagaggggtcccccgactacggtgacttcgcgtcctttgactactggggccagggaaccctggtcaccgtctcctcaactagtggccaggccggccagcaccatcaccatcaccatggcgcatacccgtacgacgttccggactacgcttct

SEQ ID NO: 860 - protein, 281 aa, Artificial Sequence
  Description of Artificial Sequence: Synthetic polypeptide
QSVLTQPPSVSAPPGQKVTISCSGSSSNIGNNYVSWYQQFPGTAPKLLIYDNNKRPSGISDRFSGSKSGTSATLGIAGLQTGDEADYYCGTWDTSLSGFYVFGSGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSSTSGQAGQHHHHHHGAYPYDVPDYAS

SEQ ID NO: 861 - DNA, 840 bp, Artificial Sequence
  Description of Artificial Sequence: Synthetic polynucleotide
ctgcctgtgctgactcagccaccctcagcgtctgcgacccccgggcagagggtcaccatctcttgttctggaaccacctccaacatcggaagtaatactgtacactggtaccagcagctcccagggacggcccccaaactcctcatctataataataatcagcggccctcaggggtccctgaccgattctctggctccaagtctggcacctcagcctccctggccatcagtgggctccggtccgaggatgaggctacatattcctgtgcaacatgggatgacagcctgagtggtgtggtcttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagatcccgcctacggtgactacgagtatgatgcttttgatatctggggccaagggacaatggtcaccgtctcttcaactagtggccaggccggccagcaccatcaccatcaccatggcgcatacccgtacgacgttccggactacgcttct

SEQ ID NO: 862 - protein, 280 aa, Artificial Sequence
  Description of Artificial Sequence: Synthetic polypeptide
LPVLTQPPSASATPGQRVTISCSGTTSNIGSNTVHWYQQLPGTAPKLLIYNNNQRPSGVPDRFSGSKSGTSASLAISGLRSEDEATYSCATWDDSLSGVVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDPAYGDYEYDAFDIWGQGTMVTVSSTSGQAGQHHHHHHGAYPYDVPDYAS

SEQ ID NO: 863 - DNA, 825 bp, Artificial Sequence
  Description of Artificial Sequence: Synthetic polynucleotide
cagtctgtgttgacgcagccgccctcagcgtctgggacccccgggcagagggtcaccatctcttgttctggaagcagctccaacatcggaactaatggtgtaaactggttccagcagttcccaggaacggcccccaaactcctcatctatactaatgatcagcggccctcaggggtccctgaccgattctctggctccaagtctggcacctcagcctccctggccatcagtgggctccagtctgcggatgaggctgattattactgtgcagtgtgggaccacagcctgaatggtccggtgttcggcggagggaccaagctgaccgtcctaggttctagaggtggtggtggtagcggcggcggcggctctggtggtggtggatccctcgagatggcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaggggccggttttgatgcttttgatatctggggccaagggacaatggtcaccgtctcttcaactagtggccaggccggccagcaccatcaccatcaccatggcgcatacccgtacgacgttccggactacgcttct

SEQ ID NO: 864 - protein, 275 aa, Artificial Sequence
  Description of Artificial Sequence: Synthetic polypeptide
QSVLTQPPSASGTPGQRVTISCSGSSSNIGTNGVNWFQQFPGTAPKLLIYTNDQRPSGVPDRFSGSKSGTSASLAISGLQSADEADYYCAVWDHSLNGPVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGAGFDAFDIWGQGTMVTVSSTSGQAGQHHHHHHGAYPYDVPDYAS

SEQ ID NO: 865 - DNA, 819 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgagactgattattactgtgcagcatgggatgacagcctgaatggttatgtcttcggaactgggaccaaggtcaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagaggggctagatgcttttgatatctggggccaagggacaatggtcaccgtctcttcaactagtggccaggccggccagcaccatcaccatcaccatggcgcatacccgtacgacgttccggactacgcttct

SEQ ID NO: 866 - protein, 273 aa, Artificial Sequence
  Description of Artificial Sequence: Synthetic polypeptide
QAVLTQPPSASGTPGQRVTISCSGSSSNIGSNTVNWYQQLPGTAPKLLIYSNNQRPSGVPDRFSGSKSGTSASLAISGLQSEDETDYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSSTSGQAGQHHHHHHGAYPYDVPDYAS

SEQ ID NO: 867 - DNA, 819 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatgtatagtaatgatcagcggccctcaggggtccctgaccgattctctggctccaagtctggcacctcagcctccctggccatcagtgggctccagtctgaggatgaggctgattattattgtgcagcatgggatgacagcctgaatggttatgtcttcgcagctgggacccagctcaccgttttaagttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagaggggctagatgcttttgatatctggggccaagggacaatggtcaccgtctcttcaactagtggccaggccggccagcaccatcaccatcaccatggcgcatacccgtacgacgttccggactacgcttct

SEQ ID NO: 868 - protein, 273 aa, Artificial Sequence
  Description of Artificial Sequence: Synthetic polypeptide
QAVLTQPPSASGTPGQRVTISCSGSSSNIGSNTVNWYQQLPGTAPKLLMYSNDQRPSGVPDRFSGSKSGTSASLAISGLQSEDEADYYCAAWDDSLNGYVFAAGTQLTVLSSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSSTSGQAGQHHHHHHGAYPYDVPDYAS

SEQ ID NO: 869 - DNA, 843 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcactggactccagactggggacgaggccgattattactgcggaacatgggatagcagcctgagtgctgcttatgtcttcggaactgggaccaaggtcaccgtcctaggttctagaggtggtggtggtagcggcggcggcggctctggtggtggtggatccctcgagatggcccaggtccagctggtacagtctggagctgaggtgaagaagcctggggcctcagtgaaggtctcctgcaaggcttctggttacagctttaccagctatactatcagctgggttcgacaggcccctggacaaggccttgagtggatgggatgggtcagcacttacaatggtctcagaaactatgcacagaacctccagggcagagtcaccatgactacagacacactcacgaccacagcctacatggagctgaggagcctcagatctgacgacacggccgtgtattattgtgtgagagaggggtcccccgactacggtgacttcgcggcctttgactactggggccagggcaccctggtcaccgtctcctcaactagtggccaggccggccagcaccatcaccatcaccatggcgcatacccgtacgacgttccggactacgcttct

SEQ ID NO: 870 - protein, 281 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAAYVFGTGTKVTVLGSRGGGGSGGGGSGGGGSLEMAQVQLVQSGAEVKKPGASVKVSCKASGYSFTSYTISWVRQAPGQGLEWMGWVSTYNGLRNYAQNLQGRVTMTTDTLTTTAYMELRSLRSDDTAVYYCVREGSPDYGDFAAFDYWGQGTLVTVSSTSGQAGQHHHHHHGAYPYDVPDYAS

SEQ ID NO: 871 - DNA, 816 bp, Artificial Sequence
  Description of Artificial Sequence: Synthetic polynucleotide
caggctgtgctgactcagccaccctcagcgtctgagacccccgggcagagggtcaccatctcttgttctggaagcaggtccaacatcggaactaatattgtacactggtaccagcagcgcccaggaatggcccccaaactcctcacttatggtagtcggcggccctcaggggtcccggaccgattctctggctccaagtttggcacctcagcctccctggccatcagtgggctccagtctgaggatgaggctgattattattgtgcagcatgggatgacagtctgaatggtccggctttcggcggagggaccaagctgaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagacggtgggggctactttgactactggggccagggaaccctggtcaccgtctcctcaactagtggccaggccggccagcaccatcaccatcaccatggcgcatacccgtacgacgttccggactacgcttct

SEQ ID NO: 872 - protein, 272 aa, Artificial Sequence
  Description of Artificial Sequence: Synthetic polypeptide
QAVLTQPPSASETPGQRVTISCSGSRSNIGTNIVHWYQQRPGMAPKLLTYGSRRPSGVPDRFSGSKFGTSASLAISGLQSEDEADYYCAAWDDSLNGPAFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDGGGYFDYWGQGTLVTVSSTSGQAGQHHHHHHGAYPYDVPDYAS

SEQ ID NO: 873 - DNA, 837 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaatatcggggcacgttatgatgtacactggtaccagcaactcccaggaacagccccccgactcctcatctctgctaactacgatcggccctcaggggtccctgaccgattctctggctccaagtctggcacctcagcctccctggccatcactgggctccaggctgaggatgaggctgattattactgccagtcctatgacagcagtgtgagtgcttgggtgttcggcggagggaccaaggtcaccgtcctaggttctagaggtggtggtggtagcggcggcggcggctctggtggtggtggatccctcgagatggccgaagtgcagctggtgcagtctggggctgaagtgaaggagcctggggcctcagtgaggatctcctgccaggcatctggatacaacttcatcagttattatatgcactgggtgcggcaggcccctgggcaaggtcttgagtggatgggcaccatcaacccaggcagtggtgagacagactactcacagaagttgcagggcagagtcaccatgaccagggacccgtccacgggtacattcgacatggggctgagcagcctgacatctggggacacggccgtctattattgtgcgacaggtctcatcagaggagctagcgatgcttttaatatctggggccgggggacaatggtcaccgtctcttcaactagtggccaggccggccagcaccatcaccatcaccatggcgcatacccgtacgacgttccggactacgcttct

SEQ ID NO: 874 - protein, 279 aa, Artificial Sequence
  Description of Artificial Sequence: Synthetic polypeptide
QSVLTQPPSVSGAPGQRVTISCTGSSSNIGARYDVHWYQQLPGTAPRLLISANYDRPSGVPDRFSGSKSGTSASLAITGLQAEDEADYYCQSYDSSVSAWVFGGGTKVTVLGSRGGGGSGGGGSGGGGSLEMAEVQLVQSGAEVKEPGASVRISCQASGYNFISYYMHWVRQAPGQGLEWMGTINPGSGETDYSQKLQGRVTMTRDPSTGTFDMGLSSLTSGDTAVYYCATGLIRGASDAFNIWGRGTMVTVSSTSGQAGQHHHHHHGAYPYDVPDYAS

SEQ ID NO: 875 - DNA, 825 bp, Artificial Sequence
  Description of Artificial Sequence: Synthetic polynucleotide
cagcctgtgctgactcagccaccctcagtgtccgtgtccccaggacagacggccgccatcccctgttctggagataagttgggggataaatttgcttcctggtatcagcagaagccaggccagtcccctgtgctggtcatctatcaagatactaagcggccctcagggatccctgagcgattctctggctccaactctgggaacacagccactctgaccatcagcgggacccaggctatggatgaggctgactattactgtcagacgtgggccagcggcattgtggtgttcggcggagggaccaagctgaccgtcctaggttctagaggtggtggtggtagcggcggcggcggctctggtggtggtggatccctcgagatggcccaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagcgcagtggctggaagggatttgactactggggccagggaaccctggtcaccgtctcctcaactagtggccaggccggccagcaccatcaccatcaccatggcgcatacccgtacgacgttccggactacgcttct

SEQ ID NO: 876 - protein, 275 aa, Artificial Sequence
  Description of Artificial Sequence: Synthetic polypeptide
QPVLTQPPSVSVSPGQTAAIPCSGDKLGDKFASWYQQKPGQSPVLVIYQDTKRPSGIPERFSGSNSGNTATLTISGTQAMDEADYYCQTWASGIVVFGGGTKLTVLGSRGGGGSGGGGSGGGGSLEMAQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARERSGWKGFDYWGQGTLVTVSSTSGQAGQHHHHHHGAYPYDVPDYAS

SEQ ID NO: 877 - DNA, 834 bp, Artificial Sequence
  Description of Artificial Sequence: Synthetic polynucleotide
gatgttgtgatgactcagtctccaccctccctgtccgtcacccctggagagccggcctccatcacctgcaggtctagtcagagcctcctggaaagaaatgcatacaactacttggattggtacctgcagaggccaggacagtctccacagctcctgatctacttgggttctaatcgggccgccggggtccctgacaggttcagtggcagtggatcaggcagagattttacactgaaaatcagcagagtggagcctgaggatgttggggtttattactgcatgcaagctctacaagctccgttcactttcggcggagggaccaaggtggagatcaaacgttctagaggtggtggtggtagcggcggcggcggctctggtggtggtggatccctcgagatggccgaagtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaatggggcccgtttcaggatgcttttgatatctggggccaagggacaatggtcaccgtctcttcaactagtggccaggccggccagcaccatcaccatcaccatggcgcatacccgtacgacgttccggactacgcttct

SEQ ID NO: 878 - protein, 278 aa, Artificial Sequence
  Description of Artificial Sequence: Synthetic polypeptide
DVVMTQSPPSLSVTPGEPASITCRSSQSLLERNAYNYLDWYLQRPGQSPQLLIYLGSNRAAGVPDRFSGSGSGRDFTLKISRVEPEDVGVYYCMQALQAPFTFGGGTKVEIKRSRGGGGSGGGGSGGGGSLEMAEVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKWGPFQDAFDIWGQGTMVTVSSTSGQAGQHHHHHHGAYPYDVPDYAS

SEQ ID NO: 879 - DNA, 843 bp, Artificial Sequence
  Description of Artificial Sequence: Synthetic polynucleotide
caggctgtgctgactcagcctgcctccgtgtctgggtctcctggacagtcgatcaccatctcctgcactggaaccagcagtgacgttggtggttataactatgtctcctggtaccaacagcacccgggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcaccccttatgtcttcggagcagggaccaaggtcaccgtcctaggttctagaggtggtggtggtagcggcggcggcggctctggtggtggtggatccctcgagatggccgaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagccaggtggacagcagtggcatcagaccaccactttgactactggggccagggaacgctggtcaccgtctcctcaactagtggccaggccggccagcaccatcaccatcaccatggcgcatacccgtacgacgttccggactacgcttct

SEQ ID NO: 880 - protein, 281 aa, Artificial Sequence
  Description of Artificial Sequence: Synthetic polypeptide
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTPYVFGAGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKARWTAVASDHHFDYWGQGTLVTVSSTSGQAGQHHHHHHGAYPYDVPDYAS

SEQ ID NO: 881 - DNA, 819 bp, Artificial Sequence
  Description of Artificial Sequence: Synthetic polynucleotide
caggctgtgcttactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaagctgaccgtcctaggttctagaggtggtggtggtagcggcggcggcggctctggtggtggtggatccctcgagatggccgaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagattgggactacatggacgtctggggcaaagggaccacggtcaccgtctcctcaactagtggccaggccggccagcaccatcaccatcaccatggcgcatacccgtacgacgttccggactacgcttct

SEQ ID NO: 882 - protein, 273 aa, Artificial Sequence
  Description of Artificial Sequence: Synthetic polypeptide
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDWDYMDVWGKGTTVTVSSTSGQAGQHHHHHHGAYPYDVPDYAS

SEQ ID NO: 883 - DNA, 852 bp, Artificial Sequence
  Description of Artificial Sequence: Synthetic polynucleotide
tcctatgagctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggttctagaggtggtggtggtagcggcggcggcggctctggtggtggtggatccctcgagatggccgaggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacctatctcggggagctaacccgcattactactactactacggtatggacgtctggggccaagggaccacggtcaccgtctcctcaactagtggccaggccggccagcaccatcaccatcaccatggcgcatacccgtacgacgttccggactacgcttct

SEQ ID NO: 884 - protein, 284 aa, Artificial Sequence
  Description of Artificial Sequence: Synthetic polypeptide
SYELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAEVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSSTSGQAGQHHHHHHGAYPYDVPDYAS

SEQ ID NO: 885 - DNA, 855 bp, Artificial Sequence
  Description of Artificial Sequence: Synthetic polynucleotide
cagtctgtgttgacgcagccgccctcagtgtctggggccccagggcagagggtcaccgtctcctgcactgggagcagatccaacatcggggcaggatatgatgtacactggtaccagcaacttccaggaacagcccccaaactcctcatctatggaaatagtaatcggcctccaggggtccctgaccgattctctgggtctaagtctggcacctcagcctccctggtcatcactgggctccaggctgaggatgccgctgattattactgccagtcctatgacaacactgtgcgtgaatcaccttatgtcttcggaactgggaccaaggtcaccgtcctaggttctagaggtggtggtggtagcggcggcggcggctctggtggtggtggatccctcgagatggccgaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagagtaatttagtgtcccggcactactactactacggtatggacgtctggggccaagggaccacggtcaccgtctcctcaactagtggccaggccggccagcaccatcaccatcaccatggcgcatacccgtacgacgttccggactacgcttct

SEQ ID NO: 886 - protein, 285 aa, Artificial Sequence
  Description of Artificial Sequence: Synthetic polypeptide
QSVLTQPPSVSGAPGQRVTVSCTGSRSNIGAGYDVHWYQQLPGTAPKLLIYGNSNRPPGVPDRFSGSKSGTSASLVITGLQAEDAADYYCQSYDNTVRESPYVFGTGTKVTVLGSRGGGGSGGGGSGGGGSLEMAEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATESNLVSRHYYYYGMDVWGQGTTVTVSSTSGQAGQHHHHHHGAYPYDVPDYAS

SEQ ID NO: 887 - DNA, 867 bp, Artificial Sequence
  Description of Artificial Sequence: Synthetic polynucleotide
ctgcctgtgctgactcagccaccctcagcgtctgggacccccgggcagagggtcaccatctcttgttctggaaccagctccaacatcggaagtaattctgtagactggtaccagcagctcccaggaacggcccccaaactcctcatctatagtaataatcagcggccctcaggggtccctgaccgaatctctggctccaagtctggcacctcagcctccctggccatcagtgggctccagtctgaggatgaggctgattattactgtgcagcatgggatgacagcctgaatggttatgtcttcggaactgggaccaaggtcaccgtcctaggttctagaggtggtggtggtagcggcggcggcggctctggtggtggtggatccctcgagatggccgaagtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagattacggatactatggttcggggagttattcgagcggccccctttactactactacggtatggacgtctggggccaagggaccacggtcaccgtctcctcaactagtggccaggccggccagcaccatcaccatcaccatggcgcatacccgtacgacgttccggactacgcttct

SEQ ID NO: 888 - protein, 289 aa, Artificial Sequence
  Description of Artificial Sequence: Synthetic polypeptide
LPVLTQPPSASGTPGQRVTISCSGTSSNIGSNSVDWYQQLPGTAPKLLIYSNNQRPSGVPDRISGSKSGTSASLAISGLQSEDEADYYCAAWDDSLNGYVFGTGTKVTVLGSRGGGGSGGGGSGGGGSLEMAEVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGYYGSGSYSSGPLYYYYGMDVWGQGTTVTVSSTSGQAGQHHHHHHGAYPYDVPDYAS

SEQ ID NO: 889 - DNA, 852 bp, Artificial Sequence
  Description of Artificial Sequence: Synthetic polynucleotide
caggctgtgctgactcagccaccctcagcgtctgggacccccgggcagagggtcaccatctcttgttctggaagcagctccaacatcggaagtaatactgtaaactggtaccagcagctcccaggaacggcccccaaactcctcatgtataataatgatcagcggccctcaggggtccctgaccgattctctggctccaagtctggcacctcagcctccctggccatcagtgggctccagtctgaggatgaggctgattattactgtgcagcatgggatgacagcctcaatggttatgtcttcggacctgggaccaaggtcaccgtcctaggttctagaggtggtggtggtagcggcggcggcggctctggtggtggtggatccctcgagatggcccaggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacctatctcggggagctaacccgcattactactactactacggtatggacgtctggggccaagggaccacggtcaccgtctcctcaactagtggccaggccggccagcaccatcaccatcaccatggcgcatacccgtacgacgttccggactacgcttct

SEQ ID NO: 890 - protein, 284 aa, Artificial Sequence
  Description of Artificial Sequence: Synthetic polypeptide
QAVLTQPPSASGTPGQRVTISCSGSSSNIGSNTVNWYQQLPGTAPKLLMYNNDQRPSGVPDRFSGSKSGTSASLAISGLQSEDEADYYCAAWDDSLNGYVFGPGTKVTVLGSRGGGGSGGGGSGGGGSLEMAQVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSSTSGQAGQHHHHHHGAYPYDVPDYAS

SEQ ID NO: 891 - DNA, 831 bp, Artificial Sequence
  Description of Artificial Sequence: Synthetic polynucleotide
aattttatgctgactcagccccacgctgtgtcggagtctccggggaagacggtaaccatctcctgcacccgcagcagtggcagtattgccagcaactatgtgcagtggtaccagcagcgcccgggcagttccccccgcactgtgatttatgaggataatcaaagaccctctggggtccctggtcggttctctggctccatcgacagctcctccaactctgcctccctcaccatctctggactgaagactgaggacgaggctgactactactgtcagtcttatgattccaccagtgtgcttttcggcggagggaccaagctgaccgtcctaggttctagaggtggtggtggtagcggcggcggcggctctggtggtggtggatccctcgagatggccgaggtccagctggtgcagtctggggctgaggtgaagaagccagggtcctcggtgaaggtctcctgcaaggcctcgggaggcaccttcagcagcaattctctcagctgggtgcgacaggcccctggacaagggcttgagtggatgggaaggatcttccctatcctgggtataacaaactatgcacagaagttccagggcagagtcacgattaccgcggacaaatccacgagcacagcctacatggagctgagcagcctgagatctgaggacacggccgtctattactgtgcgagaggaaactaccaatggtatgatgcttttgatatctggggccaagggacaatggtcaccgtctcttcaactagtggccaggccggccagcaccatcaccatcaccatggcgcatacccgtacgacgttccggactacgcttct

SEQ ID NO: 892 - protein, 277 aa, Artificial Sequence
  Description of Artificial Sequence: Synthetic polypeptide
NFMLTQPHAVSESPGKTVTISCTRSSGSIASNYVQWYQQRPGSSPRTVIYEDNQRPSGVPGRFSGSIDSSSNSASLTISGLKTEDEADYYCQSYDSTSVLFGGGTKLTVLGSRGGGGSGGGGSGGGGSLEMAEVQLVQSGAEVKKPGSSVKVSCKASGGTFSSNSLSWVRQAPGQGLEWMGRIFPILGITNYAQKFQGRVTITADKSTSTAYMELSSLRSEDTAVYYCARGNYQWYDAFDIWGQGTMVTVSSTSGQAGQHHHHHHGAYPYDVPDYAS

SEQ ID NO: 893 - DNA, 819 bp, Artificial Sequence
  Description of Artificial Sequence: Synthetic polynucleotide
cagcctgtgctgactcagccaccctcagtgtcagtggtcccaggaaagacggccaggattacctgtgggggaaaaaacattggaagtaaaagtgtgcactggtaccagcagaagccaggccaggcccctgtggtggtcatccattatgatagtgaccggccctcagggatccctgagcgattctctggctccaactctgggaacacggccaccctgaccatcagcagggtcgaagccggggatgaggccgactattactgtcaggtgtgggatagtagtagtgatcatccttatgtcttcggaactgggaccaaggtcaccgtcctaggttctagaggtggtggtggtagcggcggcggcggctctggtggtggtggatccctcgagatggcccaggtgcagctggtgcagtctggagctgaggtgaagaagcctggggcctcagtgaaggtctcctgcaaggcttctggttacacctttaccaactatggtatcagctgggtgcgacaggcccctggacaagggcttgagtggatgggatggatcagcgcttacaatggtaacacaaactatgcacataagctccagggcagagtcaccatgaccacagacacatccacgagcacagccaacatggagctgaggagcctgagacctgacgacactgccgtgtattactgtgcgcgctcttacttcggttctcatgattactggggtcaaggtactctggtgaccgtctcctcaactagtggccaggccggccagcaccatcaccatcaccatggcgcatacccgtacgacgttccggactacgcttct

SEQ ID NO: 894 - protein, 273 aa, Artificial Sequence
  Description of Artificial Sequence: Synthetic polypeptide
QPVLTQPPSVSVVPGKTARITCGGKNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAQVQLVQSGAEVKKPGASVKVSCKASGYTFTNYGISWVRQAPGQGLEWMGWISAYNGNTNYAHKLQGRVTMTTDTSTSTANMELRSLRPDDTAVYYCARSYFGSHDYWGQGTLVTVSSTSGQAGQHHHHHHGAYPYDVPDYAS

SEQ ID NO: 895 - DNA, 834 bp, Artificial Sequence
  Description of Artificial Sequence: Synthetic polynucleotide
tcctatgtgctgactcagccaccctcggtgtcagtggccccaggaaagacggccaggatttcctgtgggggaaacgacattggaagtaaaagtgttttctggtatcagcagaggccaggccaggcccctgtgttggtcgtctatgatgatagcgaccggccctcagggctccctgagcgattctctggcttcaactctgggaacacggccaccctgaccatcagcagggtcgaagccggggatgaggccgactattactgtcaagtgtgggatagtagtagtgatcattatgtcttcggaactgggaccaaggtcaccgtcctaggttctagaggtggtggtggtagcggcggcggcggctctggtggtggtggatccctcgagatggcccaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatataacctatggttcggggagttatggtgcttttgatatctggggccaagggacaatggtcaccgtctcttcaactagtggccaggccggccagcaccatcaccatcaccatggcgcatacccgtacgacgttccggactacgcttct

SEQ ID NO: 896 - protein, 278 aa, Artificial Sequence
  Description of Artificial Sequence: Synthetic polypeptide
SYVLTQPPSVSVAPGKTARISCGGNDIGSKSVFWYQQRPGQAPVLVVYDDSDRPSGLPERFSGFNSGNTATLTISRVEAGDEADYYCQVWDSSSDHYVFGTGTKVTVLGSRGGGGSGGGGSGGGGSLEMAQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDITYGSGSYGAFDIWGQGTMVTVSSTSGQAGQHHHHHHGAYPYDVPDYAS

SEQ ID NO: 897 - protein, 15 aa, Artificial Sequence
  Description of Artificial Sequence: Synthetic peptide
GGGGSGGGGSGGGGS

SEQ ID NO: 898 - DNA, 45 bp, Artificial Sequence
  Description of Artificial Sequence: Synthetic oligonucleotide
ggtggaggtggatcaggtggaggtggatctggtggaggtggatct

SEQ ID NO: 899 - protein, 977 aa, Homo sapiens [sequence omitted]

SEQ ID NO: 900 - protein, 87 aa, Homo sapiens
RPVLTLRAPGTHAAVGDLLELHCEALRGSPLILYRFFHEDVTLGNRSSPSGGASLNLSLTAEHSGNYSCEADNGLGAQRSETVTLYI

SEQ ID NO: 901 - protein, 5 aa, Artificial Sequence
  Description of Artificial Sequence: Synthetic peptide
GGGGS

SEQ ID NO: 902 - protein, 7 aa, Artificial Sequence
  Description of Artificial Sequence: Synthetic peptide
SGGSGGS

SEQ ID NO: 903 - protein, 9 aa, Artificial Sequence
  Description of Artificial Sequence: Synthetic peptide
GGGGSGGGS

SEQ ID NO: 904 - protein, 10 aa, Artificial Sequence
  Description of Artificial Sequence: Synthetic peptide
GGGGSGGGGS

SEQ ID NO: 905 - protein, 18 aa, Artificial Sequence
  Description of Artificial Sequence: Synthetic peptide
GGGGSGGGGSGGGGGGGS

SEQ ID NO: 906 - protein, 20 aa, Artificial Sequence
  Description of Artificial Sequence: Synthetic peptide
GGGGSGGGGSGGGGSGGGGS

SEQ ID NO: 907 - protein, 25 aa, Artificial Sequence
  Description of Artificial Sequence: Synthetic peptide
GGGGSGGGGSGGGGSGGGGSGGGGS

SEQ ID NO: 908 - protein, 30 aa, Artificial Sequence
  Description of Artificial Sequence: Synthetic polypeptide
GGGGSGGGGSGGGGSGGGGSGGGGSGGGGS

SEQ ID NO: 909 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 910 - protein, 15 aa, Artificial Sequence
  Description of Artificial Sequence: Synthetic peptide
EPKSCDKTHTCPPCP

SEQ ID NO: 911 - protein, 24 aa, Artificial Sequence
  Description of Artificial Sequence: Synthetic peptide
GGGGSGGGSEPKSCDKTHTCPPCP

SEQ ID NO: 912 - protein, 62 aa, Artificial Sequence
  Description of Artificial Sequence: Synthetic polypeptide
ELKTPLGDTTHTCPRCPEPKSCDTPPPCPRCPEPKSCDTPPPCPRCPEPKSCDTPPPCPRCP

SEQ ID NO: 913 - protein, 6 aa, Artificial Sequence
  Description of Artificial Sequence: Synthetic peptide
GSGSGS

SEQ ID NO: 914 - protein, 3 aa, Artificial Sequence
  Description of Artificial Sequence: Synthetic peptide
AAA

SEQ ID NO: 915 - protein, 116 aa, Artificial Sequence
  Description of Artificial Sequence: Synthetic polypeptide
VKLQESGGGLVQPGGSRKLSCAASGFTFSIFGLHWVRQAPEKGLEWVAYISGDSNTIYYADTVKGRFTISRDNPKNTLFLQMTSLRSEDTAMYYCARNSYYALDYWGQGTTVTVSS

SEQ ID NO: 916 - DNA, 348 bp, Artificial Sequence
  Description of Artificial Sequence: Synthetic polynucleotide
gtgaagctgcaggagtctgggggaggcttagtgcagcctggagggtcccggaaactctcctgtgcagcctctggattcactttcagtatctttggattgcactgggttcgtcaggctccagagaaggggctggagtgggtcgcatacattagtggtgacagtaataccatctactatgcagacacagtgaagggccgattcaccatctccagagacaatcccaagaacaccctgttcctgcaaatgaccagtctaaggtctgaggacacggccatgtattactgtgcaagaaatagctactatgctctggactactggggccaagggaccacggtcaccgtctcctca

SEQ ID NO: 917 - protein, 107 aa, Artificial Sequence
  Description of Artificial Sequence: Synthetic polypeptide
DIELTQSPAIMSVSPGEKVTMTCRASSSVSSSYLHWYQQRSGASPKIWIYSTSNLASGVPARFSGSGTGTSYSLTISSVEAEDAATYYCQQYSGYPWTFGGGTKLEI

SEQ ID NO: 918 - DNA, 321 bp, Artificial Sequence
  Description of Artificial Sequence: Synthetic polynucleotide
gacattgagctcacccagtctccagcaatcatgtctgtatctccaggtgaaaaggtcaccatgacctgcagggccagctcaagtgtcagttccagttacttgcactggtaccagcagaggtcaggtgcctcccccaaaatctggatttatagcacatccaacttggcttctggagtccctgctcgcttcagtggcagtgggactgggacctcttactctctcacaatcagcagtgtggaggctgaagatgctgccacttattactgccagcagtacagtggttacccgtggacgttcggtggagggaccaagctggagatc

SEQ ID NO: 919 - protein, 119 aa, Artificial Sequence
  Description of Artificial Sequence: Synthetic polypeptide
VQLQESGGGLVQPGGSRKLSCTASGFTFSSFGMHWVRQAPEKGLEWVAYISSGSNNIYFADTVKGRFTISRDNPKNTLFLQMTSLRSEDTAMYYCARSEYYGSSHMDYWGQGTTVTVSS

SEQ ID NO: 920 - DNA, 357 bp, Artificial Sequence
  Description of Artificial Sequence: Synthetic polynucleotide
gtccaactgcaggagtcagggggaggcttagtgcagcctggagggtcccggaaactctcctgtacagcctctggattcactttcagtagctttggaatgcactgggttcgtcaggctccagagaaggggctggagtgggtcgcatacattagtagtggcagtaataacatctactttgcggacacagtgaagggccgattcaccatctccagagacaatcccaagaacaccctgttcctgcaaatgaccagtctaaggtctgaggacacggccatgtattactgtgcaagatcggaatactacggtagtagccatatggactactggggccaagggaccacggtcaccgtctcctca

SEQ ID NO: 921 - protein, 106 aa, Artificial Sequence
  Description of Artificial Sequence: Synthetic polypeptide
DIELTQSPKFMSTSVGDRVSVTCKASQNVGTNVAWYQQKPGQSPKPLIYSATYRNSGVPDRFTGSGSGTDFTLTITNVQSKDLADYFCQQYNRYPYTSGGGTKLEI

SEQ ID NO: 922 - DNA, 318 bp, Artificial Sequence
  Description of Artificial Sequence: Synthetic polynucleotide
gacattgagctcacccagtctccaaaattcatgtccacatcagtaggagacagggtcagcgtcacctgcaaggccagtcagaatgtgggtactaatgtagcctggtatcaacagaaaccaggacaatctcctaaaccactgatttactcggcaacctaccggaacagtggagtccctgatcgcttcacaggcagtggatctgggacagatttcactctcaccatcactaacgtgcagtctaaagacttggcagactatttctgtcaacaatataacaggtatccgtacacgtccggaggggggaccaagctggagatc

SEQ ID NO: 923 - protein, 5 aa, Artificial Sequence
  Description of Artificial Sequence: Synthetic peptide
IFGLH

SEQ ID NO: 924 - protein, 17 aa, Artificial Sequence
  Description of Artificial Sequence: Synthetic peptide
YISGDSNTIYYADTVKG

SEQ ID NO: 925 - protein, 8 aa, Artificial Sequence
  Description of Artificial Sequence: Synthetic peptide
NSYYALDY

SEQ ID NO: 926 - protein, 12 aa, Artificial Sequence
  Description of Artificial Sequence: Synthetic peptide
RASSSVSSSYLH

SEQ ID NO: 927 - protein, 7 aa, Artificial Sequence
  Description of Artificial Sequence: Synthetic peptide
STSNLAS

SEQ ID NO: 928 - protein, 9 aa, Artificial Sequence
  Description of Artificial Sequence: Synthetic peptide
QQYSGYPWT

SEQ ID NO: 929 - protein, 5 aa, Artificial Sequence
  Description of Artificial Sequence: Synthetic peptide
SFGMH

SEQ ID NO: 930 - protein, 17 aa, Artificial Sequence
  Description of Artificial Sequence: Synthetic peptide
YISSGSNNIYFADTVKG

SEQ ID NO: 931 - protein, 11 aa, Artificial Sequence
  Description of Artificial Sequence: Synthetic peptide
SEYYGSSHMDY

SEQ ID NO: 932 - protein, 11 aa, Artificial Sequence
  Description of Artificial Sequence: Synthetic peptide
KASQNVGTNVA

SEQ ID NO: 933 - protein, 7 aa, Artificial Sequence
  Description of Artificial Sequence: Synthetic peptide
SATYRNS

SEQ ID NO: 934 - protein, 9 aa, Artificial Sequence
  Description of Artificial Sequence: Synthetic peptide
QQYNRYPYT

SEQ ID NO: 935 - protein, 20 aa, Artificial Sequence
  Description of Artificial Sequence: Synthetic peptide
MALPVTALLLPLALLLHAAR

SEQ ID NO: 936 - DNA, 60 bp, Artificial Sequence
  Description of Artificial Sequence: Synthetic oligonucleotide
atggctctcccagtgactgccctactgcttcccctagcgcttctcctgcatgcagctcgt

SEQ ID NO: 937 - protein, 20 aa, Artificial Sequence
  Description of Artificial Sequence: Synthetic peptide
METDTLLLWVLLLWVPGSTG

SEQ ID NO: 938 - DNA, 60 bp, Artificial Sequence
  Description of Artificial Sequence: Synthetic oligonucleotide
atggaaaccgacaccctgctgctgtgggtgctgctgctgtgggtgccaggatccacagga

SEQ ID NO: 939 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 940 - DNA, 321 bp, Homo sapiens
attgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcc

SEQ ID NO: 941 - protein, 163 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 942 - DNA, 339 bp, Homo sapiens
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 943 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 944 - protein, 277 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 945 - protein, 199 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 946 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 947 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 948 - protein, 525 aa, Homo sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 949 - protein, 370 aa, Homo sapiens
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFESLLPDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 950 - protein, 289 aa, Homo sapiens
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 951 - DNA, 1473 bp, Artificial Sequence
  Description of Artificial Sequence: Synthetic polynucleotide
atggctctcccagtgactgccctactgcttcccctagcgcttctcctgcatgcagctcgtgtgaagctgcaggagtctgggggaggcttagtgcagcctggagggtcccggaaactctcctgtgcagcctctggattcactttcagtatctttggattgcactgggttcgtcaggctccagagaaggggctggagtgggtcgcatacattagtggtgacagtaataccatctactatgcagacacagtgaagggccgattcaccatctccagagacaatcccaagaacaccctgttcctgcaaatgaccagtctaaggtctgaggacacggccatgtattactgtgcaagaaatagctactatgctctggactactggggccaagggaccacggtcaccgtctcctcaggtggaggtggatcaggtggaggtggatctggtggaggtggatctgacattgagctcacccagtctccagcaatcatgtctgtatctccaggtgaaaaggtcaccatgacctgcagggccagctcaagtgtcagttccagttacttgcactggtaccagcagaggtcaggtgcctcccccaaaatctggatttatagcacatccaacttggcttctggagtccctgctcgcttcagtggcagtgggactgggacctcttactctctcacaatcagcagtgtggaggctgaagatgctgccacttattactgccagcagtacagtggttacccgtggacgttcggtggagggaccaagctggagatcgaacaaaaactcatctcagaagaggatctggcggccgcaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 952 - DNA, 1482 bp, Artificial Sequence
  Description of Artificial Sequence: Synthetic polynucleotide
atggagacagacacactcctgctatgggtactgctgctctgggttccaggttccactggtgacgtccaactgcaggagtcagggggaggcttagtgcagcctggagggtcccggaaactctcctgtacagcctctggattcactttcagtagctttggaatgcactgggttcgtcaggctccagagaaggggctggagtgggtcgcatacattagtagtggcagtaataacatctactttgcggacacagtgaagggccgattcaccatctccagagacaatcccaagaacaccctgttcctgcaaatgaccagtctaaggtctgaggacacggccatgtattactgtgcaagatcggaatactacggtagtagccatatggactactggggccaagggaccacggtcaccgtctcctcaggtggaggtggatcaggtggaggtggatctggtggaggtggatctgacattgagctcacccagtctccaaaattcatgtccacatcagtaggagacagggtcagcgtcacctgcaaggccagtcagaatgtgggtactaatgtagcctggtatcaacagaaaccaggacaatctcctaaaccactgatttactcggcaacctaccggaacagtggagtccctgatcgcttcacaggcagtggatctgggacagatttcactctcaccatcactaacgtgcagtctaaagacttggcagactatttctgtcaacaatataacaggtatccgtacacgtccggaggggggaccaagctggagatcgaacaaaaactcatctcagaagaggatctggcggccgcaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 953 - DNA, 7833 bp, Artificial Sequence
  Description of Artificial Sequence: Synthetic polynucleotide
ccggtggtacctcacccttaccgagtcggcgacacagtgtgggtccgccgacaccagactaagaacctagaacctcgctggaaaggaccttacacagtcctgctgaccacccccaccgccctcaaagtagacggcatcgcagcttggatacacgccgcccacgtgaaggctgccgaccccgggggtggaccatcctctagactgccatggaaaccgatacactgctgctgtgggtgctgctgctgtgggtgccaggatccacaggctcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgattatgtcttcggaactgggaccaaggtcaccgtcctaggttctagaggtggtggtggtagcggcggcggcggctctggtggtggtggatccctcgagatggccgaggtgcagctggtggagactgggggaggcttggtcaagcctggagggtccctgagactctcctgtgcagcctctggattcaccgtcagtgactactacatgagctggatccgccaggctccagggaagggcctggagtggatttcatacattagtggtagtggtaatagcatatactacgcagactctgtgaagggccgattcaccatctccagggacaacgccaagaactcactggatctgcaaatgaccagcctgagagccgaggacacggccgtatattactgtgcgcgctctactaaattcgattactggggtcaaggtactctggtgaccgtctcctcagcggccgcacccaccacgacgccagcgccgcgaccaccaaccccggcgcccacgatcgcgtcgcagcccctgtccctgcgcccagaggcgtgccggccagcggcggggggcgcagtgcacacgagggggctggacttcgcctgtgatatctacatctgggcgcccctggccgggacttgtggggtccttctcctgtcactggttatcaccctttactgcaacaaacggggcagaaagaagctcctgtatatattcaaacaaccatttatgagaccagtacaaactactcaagaggaagatggctgtagctgccgatttccagaagaagaagaaggaggatgtgaactgagagtgaagttcagcaggagcgcagagccccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccactcgaggatccggattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcacacatgcagcatgtatcaaaattaatttggttttttttcttaagtatttacattaaatggccatagtacttaaagttacattggcttccttgaaataaacatggagtattcagaatgtgtcataaatatttctaattttaagatagtatctccattggctttctactttttcttttatttttttttgtcctctgtcttccatttgttgttgttgttgtttgtttgtttgtttgttggttggttggttaatttttttttaaagatcctacactatagttcaagctagactattagctactctgtaacccagggtgaccttgaagtcatgggtagcctgctgttttagccttcccacatctaagattacaggtatgagctatcatttttggtatattgattgattgattgattgatgtgtgtgtgtgtgattgtgtttgtgtgtgtgactgtgaaaatgtgtgtatgggtgtgtgtgaatgtgtgtatgtatgtgtgtgtgtgagtgtgtgtgtgtgtgtgtgcatgtgtgtgtgtgtgactgtgtctatgtgtatgactgtgtgtgtgtgtgtgtgtgtgtgtgtgtgtgtgtgtgtgtgtgtgttgtgaaaaaatattctatggtagtgagagccaacgctccggctcaggtgtcaggttggtttttgagacagagtctttcacttagcttggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgatgacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgctcttaggagtttcctaatacatcccaaactcaaatatataaagcatttgacttgttctatgccctagggggcggggggaagctaagccagctttttttaacatttaaaatgttaattccattttaaatgcacagatgtttttatttcataagggtttcaatgtgcatgaatgctgcaatattcctgttaccaaagctagtataaataaaaatagataaacgtggaaattacttagagtttctgtcattaacgtttccttcctcagttgacaacataaatgcgctgctgagcaagccagtttgcatctgtcaggatcaatttcccattatgccagtcatattaattactagtcaattagttgatttttatttttgacatatacatgtgaatgaaagaccccacctgtaggtttggcaagctagcttaagtaacgccattttgcaaggcatggaaaaatacataactgagaatagaaaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttatgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggccagcaacttatctgtgtctgtccgattgtctagtgtctatgactgattttatgcgcctgcgtcggtactagttagctaactagctctgtatctggcggacccgtggtggaactgacgagttcggaacacccggccgcaaccctgggagacgtcccagggacttcgggggccgtttttgtggcccgacctgagtcctaaaatcccgatcgtttaggactctttggtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtctgaaaatatgggcccgggctagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgcccccatatggccatatgagatcttatatggggcacccccgccccttgtaaacttccctgaccctgacatgacaagagttactaacagcccctctctccaagctcacttacaggctctctacttagtccagcacgaagtctggagacctctggcggcagcctaccaagaacaactggaccga

SEQ ID NO: 954 - DNA, 7848 bp, Artificial Sequence
  Description of Artificial Sequence: Synthetic polynucleotide
ccggtggtacctcacccttaccgagtcggcgacacagtgtgggtccgccgacaccagactaagaacctagaacctcgctggaaaggaccttacacagtcctgctgaccacccccaccgccctcaaagtagacggcatcgcagcttggatacacgccgcccacgtgaaggctgccgaccccgggggtggaccatcctctagactgccatggaaaccgatacactgctgctgtgggtgctgctgctgtgggtgccaggatccacaggcaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgcgctctaactactactacaacgattactggggtcaaggtactctggtgaccgtctcctcagcggccgcacccaccacgacgccagcgccgcgaccaccaaccccggcgcccacgatcgcgtcgcagcccctgtccctgcgcccagaggcgtgccggccagcggcggggggcgcagtgcacacgagggggctggacttcgcctgtgatatctacatctgggcgcccctggccgggacttgtggggtccttctcctgtcactggttatcaccctttactgcaacaaacggggcagaaagaagctcctgtatatattcaaacaaccatttatgagaccagtacaaactactcaagaggaagatggctgtagctgccgatttccagaagaagaagaaggaggatgtgaactgagagtgaagttcagcaggagcgcagagccccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccactcgaggatccggattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcacacatgcagcatgtatcaaaattaatttggttttttttcttaagtatttacattaaatggccatagtacttaaagttacattggcttccttgaaataaacatggagtattcagaatgtgtcataaatatttctaattttaagatagtatctccattggctttctactttttcttttatttttttttgtcctctgtcttccatttgttgttgttgttgtttgtttgtttgtttgttggttggttggttaatttttttttaaagatcctacactatagttcaagctagactattagctactctgtaacccagggtgaccttgaagtcatgggtagcctgctgttttagccttcccacatctaagattacaggtatgagctatcatttttggtatattgattgattgattgattgatgtgtgtgtgtgtgattgtgtttgtgtgtgtgactgtgaaaatgtgtgtatgggtgtgtgtgaatgtgtgtatgtatgtgtgtgtgtgagtgtgtgtgtgtgtgtgtgcatgtgtgtgtgtgtgactgtgtctatgtgtatgactgtgtgtgtgtgtgtgtgtgtgtgtgtgtgtgtgtgtgtgtgtgtgttgtgaaaaaatattctatggtagtgagagccaacgctccggctcaggtgtcaggttggtttttgagacagagtctttcacttagcttggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgatgacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgctcttaggagtttcctaatacatcccaaactcaaatatataaagcatttgacttgttctatgccctagggggcggggggaagctaagccagctttttttaacatttaaaatgttaattccattttaaatgcacagatgtttttatttcataagggtttcaatgtgcatgaatgctgcaatattcctgttaccaaagctagtataaataaaaatagataaacgtggaaattacttagagtttctgtcattaacgtttccttcctcagttgacaacataaatgcgctgctgagcaagccagtttgcatctgtcaggatcaatttcccattatgccagtcatattaattactagtcaattagttgatttttatttttgacatatacatgtgaatgaaagaccccacctgtaggtttggcaagctagcttaagtaacgccattttgcaaggcatggaaaaatacataactgagaatagaaaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttatgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggccagcaacttatctgtgtctgtccgattgtctagtgtctatgactgattttatgcgcctgcgtcggtactagttagctaactagctctgtatctggcggacccgtggtggaactgacgagttcggaacacccggccgcaaccctgggagacgtcccagggacttcgggggccgtttttgtggcccgacctgagtcctaaaatcccgatcgtttaggactctttggtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtctgaaaatatgggcccgggctagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgcccccatatggccatatgagatcttatatggggcacccccgccccttgtaaacttccctgaccctgacatgacaagagttactaacagcccctctctccaagctcacttacaggctctctacttagtccagcacgaagtctggagacctctggcggcagcctaccaagaacaactggaccga

SEQ ID NO: 955 - DNA, 7872 bp, Artificial Sequence
  Description of Artificial Sequence: Synthetic polynucleotide
ccggtggtacctcacccttaccgagtcggcgacacagtgtgggtccgccgacaccagactaagaacctagaacctcgctggaaaggaccttacacagtcctgctgaccacccccaccgccctcaaagtagacggcatcgcagcttggatacacgccgcccacgtgaaggctgccgaccccgggggtggaccatcctctagactgccatggaaaccgacaccctgctgctgtgggtgctgctgctgtgggtgccaggatccacaggacagtctgtcgtgacgcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggttatgtcttcggaactgggaccaagctgaccgtcctaggttctagaggtggtggtggtagcggcggcggcggctctggtggtggtggatccctcgagatggcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactgtgcgcgcctgtacgaaggtggttaccatggttggggttcttggctgtcttctgattcttggggtcaaggtactctggtgaccgtctcctcagcggccgcacccaccacgacgccagcgccgcgaccaccaaccccggcgcccacgatcgcgtcgcagcccctgtccctgcgcccagaggcgtgccggccagcggcggggggcgcagtgcacacgagggggctggacttcgcctgtgatatctacatctgggcgcccctggccgggacttgtggggtccttctcctgtcactggttatcaccctttactgcaacaaacggggcagaaagaagctcctgtatatattcaaacaaccatttatgagaccagtacaaactactcaagaggaagatggctgtagctgccgatttccagaagaagaagaaggaggatgtgaactgagagtgaagttcagcaggagcgcagagccccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccactcgaggatccggattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcacacatgcagcatgtatcaaaattaatttggttttttttcttaagtatttacattaaatggccatagtacttaaagttacattggcttccttgaaataaacatggagtattcagaatgtgtcataaatatttctaattttaagatagtatctccattggctttctactttttcttttatttttttttgtcctctgtcttccatttgttgttgttgttgtttgtttgtttgtttgttggttggttggttaatttttttttaaagatcctacactatagttcaagctagactattagctactctgtaacccagggtgaccttgaagtcatgggtagcctgctgttttagccttcccacatctaagattacaggtatgagctatcatttttggtatattgattgattgattgattgatgtgtgtgtgtgtgattgtgtttgtgtgtgtgactgtgaaaatgtgtgtatgggtgtgtgtgaatgtgtgtatgtatgtgtgtgtgtgagtgtgtgtgtgtgtgtgtgcatgtgtgtgtgtgtgactgtgtctatgtgtatgactgtgtgtgtgtgtgtgtgtgtgtgtgtgtgtgtgtgtgtgtgtgtgttgtgaaaaaatattctatggtagtgagagccaacgctccggctcaggtgtcaggttggtttttgagacagagtctttcacttagcttggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgatgacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgctcttaggagtttcctaatacatcccaaactcaaatatataaagcatttgacttgttctatgccctagggggcggggggaagctaagccagctttttttaacatttaaaatgttaattccattttaaatgcacagatgtttttatttcataagggtttcaatgtgcatgaatgctgcaatattcctgttaccaaagctagtataaataaaaatagataaacgtggaaattacttagagtttctgtcattaacgtttccttcctcagttgacaacataaatgcgctgctgagcaagccagtttgcatctgtcaggatcaatttcccattatgccagtcatattaattactagtcaattagttgatttttatttttgacatatacatgtgaatgaaagaccccacctgtaggtttggcaagctagcttaagtaacgccattttgcaaggcatggaaaaatacataactgagaatagaaaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttatgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggccagcaacttatctgtgtctgtccgattgtctagtgtctatgactgattttatgcgcctgcgtcggtactagttagctaactagctctgtatctggcggacccgtggtggaactgacgagttcggaacacccggccgcaaccctgggagacgtcccagggacttcgggggccgtttttgtggcccgacctgagtcctaaaatcccgatcgtttaggactctttggtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtctgaaaatatgggcccgggctagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgcccccatatggccatatgagatcttatatggggcacccccgccccttgtaaacttccctgaccctgacatgacaagagttactaacagcccctctctccaagctcacttacaggctctctacttagtccagcacgaagtctggagacctctggcggcagcctaccaagaacaactggaccga

SEQ ID NO: 956 - DNA, 7845 bp, Artificial Sequence
  Description of Artificial Sequence: Synthetic polynucleotide
ccggtggtacctcacccttaccgagtcggcgacacagtgtgggtccgccgacaccagactaagaacctagaacctcgctggaaaggaccttacacagtcctgctgaccacccccaccgccctcaaagtagacggcatcgcagcttggatacacgccgcccacgtgaaggctgccgaccccgggggtggaccatcctctagactgccatggaaaccgacaccctgctgctgtgggtgctgctgctgtgggtgccaggatccacaggaaattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatgtggtattcggcggagggaccaaggtcaccgtcctaggttctagaggtggtggtggtagcggcggcggcggctctggtggtggtggatccctcgagatggccgaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcacgctgggactacggtatggacgtctggggccaagggaccacggtcaccgtctcctcagcggccgcacccaccacgacgccagcgccgcgaccaccaaccccggcgcccacgatcgcgtcgcagcccctgtccctgcgcccagaggcgtgccggccagcggcggggggcgcagtgcacacgagggggctggacttcgcctgtgatatctacatctgggcgcccctggccgggacttgtggggtccttctcctgtcactggttatcaccctttactgcaacaaacggggcagaaagaagctcctgtatatattcaaacaaccatttatgagaccagtacaaactactcaagaggaagatggctgtagctgccgatttccagaagaagaagaaggaggatgtgaactgagagtgaagttcagcaggagcgcagagccccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccactcgaggatccggattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcacacatgcagcatgtatcaaaattaatttggttttttttcttaagtatttacattaaatggccatagtacttaaagttacattggcttccttgaaataaacatggagtattcagaatgtgtcataaatatttctaattttaagatagtatctccattggctttctactttttcttttatttttttttgtcctctgtcttccatttgttgttgttgttgtttgtttgtttgtttgttggttggttggttaatttttttttaaagatcctacactatagttcaagctagactattagctactctgtaacccagggtgaccttgaagtcatgggtagcctgctgttttagccttcccacatctaagattacaggtatgagctatcatttttggtatattgattgattgattgattgatgtgtgtgtgtgtgattgtgtttgtgtgtgtgactgtgaaaatgtgtgtatgggtgtgtgtgaatgtgtgtatgtatgtgtgtgtgtgagtgtgtgtgtgtgtgtgtgcatgtgtgtgtgtgtgactgtgtctatgtgtatgactgtgtgtgtgtgtgtgtgtgtgtgtgtgtgtgtgtgtgtgtgtgtgttgtgaaaaaatattctatggtagtgagagccaacgctccggctcaggtgtcaggttggtttttgagacagagtctttcacttagcttggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgatgacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgctcttaggagtttcctaatacatcccaaactcaaatatataaagcatttgacttgttctatgccctagggggcggggggaagctaagccagctttttttaacatttaaaatgttaattccattttaaatgcacagatgtttttatttcataagggtttcaatgtgcatgaatgctgcaatattcctgttaccaaagctagtataaataaaaatagataaacgtggaaattacttagagtttctgtcattaacgtttccttcctcagttgacaacataaatgcgctgctgagcaagccagtttgcatctgtcaggatcaatttcccattatgccagtcatattaattactagtcaattagttgatttttatttttgacatatacatgtgaatgaaagaccccacctgtaggtttggcaagctagcttaagtaacgccattttgcaaggcatggaaaaatacataactgagaatagaaaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttatgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggccagcaacttatctgtgtctgtccgattgtctagtgtctatgactgattttatgcgcctgcgtcggtactagttagctaactagctctgtatctggcggacccgtggtggaactgacgagttcggaacacccggccgcaaccctgggagacgtcccagggacttcgggggccgtttttgtggcccgacctgagtcctaaaatcccgatcgtttaggactctttggtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtctgaaaatatgggcccgggctagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgcccccatatggccatatgagatcttatatggggcacccccgccccttgtaaacttccctgaccctgacatgacaagagttactaacagcccctctctccaagctcacttacaggctctctacttagtccagcacgaagtctggagacctctggcggcagcctaccaagaacaactggaccga

SEQ ID NO: 957 - DNA, 7854 bp, Artificial Sequence
  Description of Artificial Sequence: Synthetic polynucleotide
ccggtggtacctcacccttaccgagtcggcgacacagtgtgggtccgccgacaccagactaagaacctagaacctcgctggaaaggaccttacacagtcctgctgaccacccccaccgccctcaaagtagacggcatcgcagcttggatacacgccgcccacgtgaaggctgccgaccccgggggtggaccatcctctagactgccatggaaaccgatacactgctgctgtgggtgctgctgctgtgggtgccaggatccacaggctcctatgtgctgactcagccaccctcagtgtccgtgtccccaggacagacagccagcatcacctgctctggagatagattgacgaataaatatgtttcctggtatcaacagaagccaggccagtcccctgtgttggtcatctatgaggatgccaagcggccctcagggatccctgcgcgattctctggctccaactctgggaacacagccactctgaccatcagcgggacccaggctatggatgagtctgaatattactgtcaggcgtgggacagcagtgtggtggtttttggcggagggaccaagctgaccgtcctaggttctagaggtggtggtggtagcggcggcggcggctctggtggtggtggatccctcgagatggccgaggtgcagctggtggagtctgggggaggcttggtacagcctggcaggtccctgagactctcctgtgcagcctctggatttacctttgatgattatgccatgcactgggtccggcaagctccagggaagggcctggagtgggtctcaggtattagttggaatagtggtagtataggctatgcggactctgtgaagggccgattcaccatctccagagacaacgccaagaactccctgtatctgcaaatgaacagtctgagagatgaggacacggccttgtattactgtgcaaaagaccgaggggggggagttatcgttaaggatgcttttgatatctggggccaagggacaatggtcaccgtctcttcagcggccgcacccaccacgacgccagcgccgcgaccaccaaccccggcgcccacgatcgcgtcgcagcccctgtccctgcgcccagaggcgtgccggccagcggcggggggcgcagtgcacacgagggggctggacttcgcctgtgatatctacatctgggcgcccctggccgggacttgtggggtccttctcctgtcactggttatcaccctttactgcaacaaacggggcagaaagaagctcctgtatatattcaaacaaccatttatgagaccagtacaaactactcaagaggaagatggctgtagctgccgatttccagaagaagaagaaggaggatgtgaactgagagtgaagttcagcaggagcgcagagccccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccactcgaggatccggattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcacacatgcagcatgtatcaaaattaatttggttttttttcttaagtatttacattaaatggccatagtacttaaagttacattggcttccttgaaataaacatggagtattcagaatgtgtcataaatatttctaattttaagatagtatctccattggctttctactttttcttttatttttttttgtcctctgtcttccatttgttgttgttgttgtttgtttgtttgtttgttggttggttggttaatttttttttaaagatcctacactatagttcaagctagactattagctactctgtaacccagggtgaccttgaagtcatgggtagcctgctgttttagccttcccacatctaagattacaggtatgagctatcatttttggtatattgattgattgattgattgatgtgtgtgtgtgtgattgtgtttgtgtgtgtgactgtgaaaatgtgtgtatgggtgtgtgtgaatgtgtgtatgtatgtgtgtgtgtgagtgtgtgtgtgtgtgtgtgcatgtgtgtgtgtgtgactgtgtctatgtgtatgactgtgtgtgtgtgtgtgtgtgtgtgtgtgtgtgtgtgtgtgtgtgtgttgtgaaaaaatattctatggtagtgagagccaacgctccggctcaggtgtcaggttggtttttgagacagagtctttcacttagcttggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgatgacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgctcttaggagtttcctaatacatcccaaactcaaatatataaagcatttgacttgttctatgccctagggggcggggggaagctaagccagctttttttaacatttaaaatgttaattccattttaaatgcacagatgtttttatttcataagggtttcaatgtgcatgaatgctgcaatattcctgttaccaaagctagtataaataaaaatagataaacgtggaaattacttagagtttctgtcattaacgtttccttcctcagttgacaacataaatgcgctgctgagcaagccagtttgcatctgtcaggatcaatttcccattatgccagtcatattaattactagtcaattagttgatttttatttttgacatatacatgtgaatgaaagaccccacctgtaggtttggcaagctagcttaagtaacgccattttgcaaggcatggaaaaatacataactgagaatagaaaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttatgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggccagcaacttatctgtgtctgtccgattgtctagtgtctatgactgattttatgcgcctgcgtcggtactagttagctaactagctctgtatctggcggacccgtggtggaactgacgagttcggaacacccggccgcaaccctgggagacgtcccagggacttcgggggccgtttttgtggcccgacctgagtcctaaaatcccgatcgtttaggactctttggtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtctgaaaatatgggcccgggctagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgcccccatatggccatatgagatcttatatggggcacccccgccccttgtaaacttccctgaccctgacatgacaagagttactaacagcccctctctccaagctcacttacaggctctctacttagtccagcacgaagtctggagacctctggcggcagcctaccaagaacaactggaccga

SEQ ID NO: 958 - DNA, 7866 bp, Artificial Sequence
  Description of Artificial Sequence: Synthetic polynucleotide
ccggtggtacctcacccttaccgagtcggcgacacagtgtgggtccgccgacaccagactaagaacctagaacctcgctggaaaggaccttacacagtcctgctgaccacccccaccgccctcaaagtagacggcatcgcagcttggatacacgccgcccacgtgaaggctgccgaccccgggggtggaccatcctctagactgccatggaaaccgacaccctgctgctgtgggtgctgctgctgtgggtgccaggatccacaggactgcctgtgctgactcagccaccctcagcgtctgcgacccccgggcagagggtcaccatctcttgttctggaaccacctccaacatcggaagtaatactgtacactggtaccagcagctcccagggacggcccccaaactcctcatctataataataatcagcggccctcaggggtccctgaccgattctctggctccaagtctggcacctcagcctccctggccatcagtgggctccggtccgaggatgaggctacatattcctgtgcaacatgggatgacagcctgagtggtgtggtcttcggcggagggaccaagctgaccgtcctaggttctagaggtggtggtggtagcggcggcggcggctctggtggtggtggatccctcgagatggccgaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagatcccgcctacggtgactacgagtatgatgcttttgatatctggggccaagggacaatggtcaccgtctcttcagcggccgcacccaccacgacgccagcgccgcgaccaccaaccccggcgcccacgatcgcgtcgcagcccctgtccctgcgcccagaggcgtgccggccagcggcggggggcgcagtgcacacgagggggctggacttcgcctgtgatatctacatctgggcgcccctggccgggacttgtggggtccttctcctgtcactggttatcaccctttactgcaacaaacggggcagaaagaagctcctgtatatattcaaacaaccatttatgagaccagtacaaactactcaagaggaagatggctgtagctgccgatttccagaagaagaagaaggaggatgtgaactgagagtgaagttcagcaggagcgcagagccccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccactcgaggatccggattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcacacatgcagcatgtatcaaaattaatttggttttttttcttaagtatttacattaaatggccatagtacttaaagttacattggcttccttgaaataaacatggagtattcagaatgtgtcataaatatttctaattttaagatagtatctccattggctttctactttttcttttatttttttttgtcctctgtcttccatttgttgttgttgttgtttgtttgtttgtttgttggttggttggttaatttttttttaaagatcctacactatagttcaagctagactattagctactctgtaacccagggtgaccttgaagtcatgggtagcctgctgttttagccttcccacatctaagattacaggtatgagctatcatttttggtatattgattgattgattgattgatgtgtgtgtgtgtgattgtgtttgtgtgtgtgactgtgaaaatgtgtgtatgggtgtgtgtgaatgtgtgtatgtatgtgtgtgtgtgagtgtgtgtgtgtgtgtgtgcatgtgtgtgtgtgtgactgtgtctatgtgtatgactgtgtgtgtgtgtgtgtgtgtgtgtgtgtgtgtgtgtgtgtgtgtgttgtgaaaaaatattctatggtagtgagagccaacgctccggctcaggtgtcaggttggtttttgagacagagtctttcacttagcttggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgatgacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgctcttaggagtttcctaatacatcccaaactcaaatatataaagcatttgacttgttctatgccctagggggcggggggaagctaagccagctttttttaacatttaaaatgttaattccattttaaatgcacagatgtttttatttcataagggtttcaatgtgcatgaatgctgcaatattcctgttaccaaagctagtataaataaaaatagataaacgtggaaattacttagagtttctgtcattaacgtttccttcctcagttgacaacataaatgcgctgctgagcaagccagtttgcatctgtcaggatcaatttcccattatgccagtcatattaattactagtcaattagttgatttttatttttgacatatacatgtgaatgaaagaccccacctgtaggtttggcaagctagcttaagtaacgccattttgcaaggcatggaaaaatacataactgagaatagaaaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttatgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggccagcaacttatctgtgtctgtccgattgtctagtgtctatgactgattttatgcgcctgcgtcggtactagttagctaactagctctgtatctggcggacccgtggtggaactgacgagttcggaacacccggccgcaaccctgggagacgtcccagggacttcgggggccgtttttgtggcccgacctgagtcctaaaatcccgatcgtttaggactctttggtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtctgaaaatatgggcccgggctagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgcccccatatggccatatgagatcttatatggggcacccccgccccttgtaaacttccctgaccctgacatgacaagagttactaacagcccctctctccaagctcacttacaggctctctacttagtccagcacgaagtctggagacctctggcggcagcctaccaagaacaactggaccga

SEQ ID NO: 959 - DNA, 7860 bp, Artificial Sequence
  Description of Artificial Sequence: Synthetic polynucleotide
ccggtggtacctcacccttaccgagtcggcgacacagtgtgggtccgccgacaccagactaagaacctagaacctcgctggaaaggaccttacacagtcctgctgaccacccccaccgccctcaaagtagacggcatcgcagcttggatacacgccgcccacgtgaaggctgccgaccccgggggtggaccatcctctagactgccatggaaaccgatacactgctgctgtgggtgctgctgctgtgggtgccaggatccacaggcgatgttgtgatgactcagtctccaccctccctgtccgtcacccctggagagccggcctccatcacctgcaggtctagtcagagcctcctggaaagaaatgcatacaactacttggattggtacctgcagaggccaggacagtctccacagctcctgatctacttgggttctaatcgggccgccggggtccctgacaggttcagtggcagtggatcaggcagagattttacactgaaaatcagcagagtggagcctgaggatgttggggtttattactgcatgcaagctctacaagctccgttcactttcggcggagggaccaaggtggagatcaaacgttctagaggtggtggtggtagcggcggcggcggctctggtggtggtggatccctcgagatggccgaagtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaatggggcccgtttcaggatgcttttgatatctggggccaagggacaatggtcaccgtctcttcagcggccgcacccaccacgacgccagcgccgcgaccaccaaccccggcgcccacgatcgcgtcgcagcccctgtccctgcgcccagaggcgtgccggccagcggcggggggcgcagtgcacacgagggggctggacttcgcctgtgatatctacatctgggcgcccctggccgggacttgtggggtccttctcctgtcactggttatcaccctttactgcaacaaacggggcagaaagaagctcctgtatatattcaaacaaccatttatgagaccagtacaaactactcaagaggaagatggctgtagctgccgatttccagaagaagaagaaggaggatgtgaactgagagtgaagttcagcaggagcgcagagccccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccactcgaggatccggattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcacacatgcagcatgtatcaaaattaatttggttttttttcttaagtatttacattaaatggccatagtacttaaagttacattggcttccttgaaataaacatggagtattcagaatgtgtcataaatatttctaattttaagatagtatctccattggctttctactttttcttttatttttttttgtcctctgtcttccatttgttgttgttgttgtttgtttgtttgtttgttggttggttggttaatttttttttaaagatcctacactatagttcaagctagactattagctactctgtaacccagggtgaccttgaagtcatgggtagcctgctgttttagccttcccacatctaagattacaggtatgagctatcatttttggtatattgattgattgattgattgatgtgtgtgtgtgtgattgtgtttgtgtgtgtgactgtgaaaatgtgtgtatgggtgtgtgtgaatgtgtgtatgtatgtgtgtgtgtgagtgtgtgtgtgtgtgtgtgcatgtgtgtgtgtgtgactgtgtctatgtgtatgactgtgtgtgtgtgtgtgtgtgtgtgtgtgtgtgtgtgtgtgtgtgtgttgtgaaaaaatattctatggtagtgagagccaacgctccggctcaggtgtcaggttggtttttgagacagagtctttcacttagcttggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgatgacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgctcttaggagtttcctaatacatcccaaactcaaatatataaagcatttgacttgttctatgccctagggggcggggggaagctaagccagctttttttaacatttaaaatgttaattccattttaaatgcacagatgtttttatttcataagggtttcaatgtgcatgaatgctgcaatattcctgttaccaaagctagtataaataaaaatagataaacgtggaaattacttagagtttctgtcattaacgtttccttcctcagttgacaacataaatgcgctgctgagcaagccagtttgcatctgtcaggatcaatttcccattatgccagtcatattaattactagtcaattagttgatttttatttttgacatatacatgtgaatgaaagaccccacctgtaggtttggcaagctagcttaagtaacgccattttgcaaggcatggaaaaatacataactgagaatagaaaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttatgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggccagcaacttatctgtgtctgtccgattgtctagtgtctatgactgattttatgcgcctgcgtcggtactagttagctaactagctctgtatctggcggacccgtggtggaactgacgagttcggaacacccggccgcaaccctgggagacgtcccagggacttcgggggccgtttttgtggcccgacctgagtcctaaaatcccgatcgtttaggactctttggtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtctgaaaatatgggcccgggctagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgcccccatatggccatatgagatcttatatggggcacccccgccccttgtaaacttccctgaccctgacatgacaagagttactaacagcccctctctccaagctcacttacaggctctctacttagtccagcacgaagtctggagacctctggcggcagcctaccaagaacaactggaccga

SEQ ID NO: 960 - protein, 235 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGCYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 961 - DNA, 213 bp, Homo sapiens
cccaccacgacgccagcgccgcgaccaccaaccccggcgcccacgatcgcgtcgcagcccctgtccctgcgcccagaggcgtgccggccagcggcggggggcgcagtgcacacgagggggctggacttcgcctgtgatatctacatctgggcgcccctggccgggacttgtggggtccttctcctgtcactggttatcaccctttactgcaac

SEQ ID NO: 962 - DNA, 126 bp, Homo sapiens
aaacggggcagaaagaagctcctgtatatattcaaacaaccatttatgagaccagtacaaactactcaagaggaagatggctgtagctgccgatttccagaagaagaagaaggaggatgtgaactg

SEQ ID NO: 963 - protein, 78 aa, Homo sapiens
GTHAAVGDLLELHCEALRGSPLILYRFFHEDVTLGNRSSPSGGASLNLSLTAEHSGNYSCEADNGLGAQRSETVTLYI

SEQ ID NO: 964 - protein, 12 aa, Homo sapiens
RSETVTLYITGL

SEQ ID NO: 965 - protein, 11 aa, Homo sapiens
SRPILTFRAPR

SEQ ID NO: 966 - protein, 4 aa, Homo sapiens
YVKM

SEQ ID NO: 967 - DNA, 822 bp, Artificial Sequence; identical to SEQ ID NO: 745
  Description of Artificial Sequence: Synthetic polynucleotide

SEQ ID NO: 968 - protein, 274 aa, Artificial Sequence; identical to SEQ ID NO: 746
  Description of Artificial Sequence: Synthetic polypeptide

SEQ ID NO: 969 - DNA, 822 bp, Artificial Sequence; identical to SEQ ID NO: 747
  Description of Artificial Sequence: Synthetic polynucleotide

SEQ ID NO: 970 - protein, 274 aa, Artificial Sequence; identical to SEQ ID NO: 748
  Description of Artificial Sequence: Synthetic polypeptide

SEQ ID NO: 971 - DNA, 825 bp, Artificial Sequence; identical to SEQ ID NO: 749
  Description of Artificial Sequence: Synthetic polynucleotide

SEQ ID NO: 972 - protein, 275 aa, Artificial Sequence; identical to SEQ ID NO: 750
  Description of Artificial Sequence: Synthetic polypeptide

SEQ ID NO: 973 - DNA, 819 bp, Artificial Sequence; identical to SEQ ID NO: 751
  Description of Artificial Sequence: Synthetic polynucleotide

SEQ ID NO: 974 - protein, 273 aa, Artificial Sequence; identical to SEQ ID NO: 752
  Description of Artificial Sequence: Synthetic polypeptide

SEQ ID NO: 975 - DNA, 813 bp, Artificial Sequence; identical to SEQ ID NO: 753
  Description of Artificial Sequence: Synthetic polynucleotide

SEQ ID NO: 976 - protein, 271 aa, Artificial Sequence; identical to SEQ ID NO: 754
  Description of Artificial Sequence: Synthetic polypeptide

SEQ ID NO: 977 - DNA, 834 bp, Artificial Sequence; identical to SEQ ID NO: 755
  Description of Artificial Sequence: Synthetic polynucleotide

SEQ ID NO: 978 - protein, 278 aa, Artificial Sequence; identical to SEQ ID NO: 756
  Description of Artificial Sequence: Synthetic polypeptide

SEQ ID NO: 979 - DNA, 831 bp, Artificial Sequence; identical to SEQ ID NO: 757
  Description of Artificial Sequence: Synthetic polynucleotide

SEQ ID NO: 980 - protein, 277 aa, Artificial Sequence; identical to SEQ ID NO: 758
  Description of Artificial Sequence: Synthetic polypeptide

SEQ ID NO: 981 - DNA, 822 bp, Artificial Sequence; identical to SEQ ID NO: 759
  Description of Artificial Sequence: Synthetic polynucleotide

SEQ ID NO: 982 - protein, 274 aa, Artificial Sequence; identical to SEQ ID NO: 760
  Description of Artificial Sequence: Synthetic polypeptide

SEQ ID NO: 983 - DNA, 825 bp, Artificial Sequence; identical to SEQ ID NO: 761
  Description of Artificial Sequence: Synthetic polynucleotide

SEQ ID NO: 984 - protein, 275 aa, Artificial Sequence; identical to SEQ ID NO: 762
  Description of Artificial Sequence: Synthetic polypeptide

SEQ ID NO: 985 - DNA, 822 bp, Artificial Sequence; identical to SEQ ID NO: 763
  Description of Artificial Sequence: Synthetic polynucleotide

SEQ ID NO: 986 - protein, 274 aa, Artificial Sequence; identical to SEQ ID NO: 764
  Description of Artificial Sequence: Synthetic polypeptide

SEQ ID NO: 987 - DNA, 828 bp, Artificial Sequence; identical to SEQ ID NO: 765
  Description of Artificial Sequence: Synthetic polynucleotide

SEQ ID NO: 988 - protein, 276 aa, Artificial Sequence; identical to SEQ ID NO: 766
  Description of Artificial Sequence: Synthetic polypeptide

SEQ ID NO: 989 - DNA, 822 bp, Artificial Sequence; identical to SEQ ID NO: 767
  Description of Artificial Sequence: Synthetic polynucleotide

SEQ ID NO: 990 - protein, 274 aa, Artificial Sequence; identical to SEQ ID NO: 768
  Description of Artificial Sequence: Synthetic polypeptide

SEQ ID NO: 991 - DNA, 816 bp, Artificial Sequence; identical to SEQ ID NO: 769
  Description of Artificial Sequence: Synthetic polynucleotide

SEQ ID NO: 992 - protein, 272 aa, Artificial Sequence; identical to SEQ ID NO: 770
  Description of Artificial Sequence: Synthetic polypeptide

SEQ ID NO: 993 - DNA, 810 bp, Artificial Sequence; identical to SEQ ID NO: 771
  Description of Artificial Sequence: Synthetic polynucleotide

SEQ ID NO: 994 - protein, 270 aa, Artificial Sequence; identical to SEQ ID NO: 772
  Description of Artificial Sequence: Synthetic polypeptide

SEQ ID NO: 995 - DNA, 810 bp, Artificial Sequence; identical to SEQ ID NO: 773
  Description of Artificial Sequence: Synthetic polynucleotide

SEQ ID NO: 996 - protein, 270 aa, Artificial Sequence; identical to SEQ ID NO: 774
  Description of Artificial Sequence: Synthetic polypeptide

SEQ ID NO: 997 - DNA, 816 bp, Artificial Sequence; identical to SEQ ID NO: 775
  Description of Artificial Sequence: Synthetic polynucleotide

SEQ ID NO: 998 - protein, 272 aa, Artificial Sequence; identical to SEQ ID NO: 776
  Description of Artificial Sequence: Synthetic polypeptide

SEQ ID NO: 999 - DNA, 870 bp, Artificial Sequence; identical to SEQ ID NO: 777
  Description of Artificial Sequence: Synthetic polynucleotide

SEQ ID NO: 1000 - protein, 290 aa, Artificial Sequence; identical to SEQ ID NO: 778
  Description of Artificial Sequence: Synthetic polypeptide

SEQ ID NO: 1001 - DNA, 822 bp, Artificial Sequence; identical to SEQ ID NO: 779
  Description of Artificial Sequence: Synthetic polynucleotide

SEQ ID NO: 1002 - protein, 274 aa, Artificial Sequence; identical to SEQ ID NO: 780
  Description of Artificial Sequence: Synthetic polypeptide

SEQ ID NO: 1003 - DNA, 822 bp, Artificial Sequence; identical to SEQ ID NO: 781
  Description of Artificial Sequence: Synthetic polynucleotide

SEQ ID NO: 1004 - protein, 274 aa, Artificial Sequence; identical to SEQ ID NO: 782
  Description of Artificial Sequence: Synthetic polypeptide

SEQ ID NO: 1005 - DNA, 831 bp, Artificial Sequence; identical to SEQ ID NO: 783
  Description of Artificial Sequence: Synthetic polynucleotide

SEQ ID NO: 1006 - protein, 277 aa, Artificial Sequence; identical to SEQ ID NO: 784
  Description of Artificial Sequence: Synthetic polypeptide

SEQ ID NO: 1007 - DNA, 822 bp, Artificial Sequence; identical to SEQ ID NO: 785
  Description of Artificial Sequence: Synthetic polynucleotide

SEQ ID NO: 1008 - protein, 274 aa, Artificial Sequence; identical to SEQ ID NO: 786
  Description of Artificial Sequence: Synthetic polypeptide

SEQ ID NO: 1009 - DNA, 825 bp, Artificial Sequence; identical to SEQ ID NO: 787
  Description of Artificial Sequence: Synthetic polynucleotide

SEQ ID NO: 1010 - protein, 275 aa, Artificial Sequence; identical to SEQ ID NO: 788
  Description of Artificial Sequence: Synthetic polypeptide

SEQ ID NO: 1011 - DNA, 816 bp, Artificial Sequence; identical to SEQ ID NO: 789
  Description of Artificial Sequence: Synthetic polynucleotide

SEQ ID NO: 1012 - protein, 272 aa, Artificial Sequence; identical to SEQ ID NO: 790
  Description of Artificial Sequence: Synthetic polypeptide

SEQ ID NO: 1013 - DNA, 822 bp, Artificial Sequence; identical to SEQ ID NO: 791
  Description of Artificial Sequence: Synthetic polynucleotide

SEQ ID NO: 1014 - protein, 274 aa, Artificial Sequence; identical to SEQ ID NO: 792
  Description of Artificial Sequence: Synthetic polypeptide

SEQ ID NO: 1015 - DNA, 852 bp, Artificial Sequence; identical to SEQ ID NO: 793
  Description of Artificial Sequence: Synthetic polynucleotide

SEQ ID NO: 1016 - protein, 284 aa, Artificial Sequence; identical to SEQ ID NO: 794
  Description of Artificial Sequence: Synthetic polypeptide

SEQ ID NO: 1017 - DNA, 828 bp, Artificial Sequence; identical to SEQ ID NO: 795
  Description of Artificial Sequence: Synthetic polynucleotide

SEQ ID NO: 1018 - protein, 276 aa, Artificial Sequence; identical to SEQ ID NO: 796
  Description of Artificial Sequence: Synthetic polypeptide

SEQ ID NO: 1019 - DNA, 822 bp, Artificial Sequence; identical to SEQ ID NO: 797
  Description of Artificial Sequence: Synthetic polynucleotide

SEQ ID NO: 1020 - protein, 274 aa, Artificial Sequence; identical to SEQ ID NO: 798
  Description of Artificial Sequence: Synthetic polypeptide

SEQ ID NO: 1021 - DNA, 825 bp, Artificial Sequence; identical to SEQ ID NO: 799
  Description of Artificial Sequence: Synthetic polynucleotide

SEQ ID NO: 1022 - protein, 275 aa, Artificial Sequence; identical to SEQ ID NO: 800
  Description of Artificial Sequence: Synthetic polypeptide

SEQ ID NO: 1023 - DNA, 807 bp, Artificial Sequence; identical to SEQ ID NO: 801
  Description of Artificial Sequence: Synthetic polynucleotide

SEQ ID NO: 1024 - protein, 269 aa, Artificial Sequence; identical to SEQ ID NO: 802
  Description of Artificial Sequence: Synthetic polypeptide

SEQ ID NO: 1025 - DNA, 828 bp, Artificial Sequence; identical to SEQ ID NO: 803
  Description of Artificial Sequence: Synthetic polynucleotide

SEQ ID NO: 1026 - protein, 276 aa, Artificial Sequence; identical to SEQ ID NO: 804
  Description of Artificial Sequence: Synthetic polypeptide

SEQ ID NO: 1027 - DNA, 819 bp, Artificial Sequence; identical to SEQ ID NO: 805
  Description of Artificial Sequence: Synthetic polynucleotide

SEQ ID NO: 1028 - protein, 273 aa, Artificial Sequence; identical to SEQ ID NO: 806
  Description of Artificial Sequence: Synthetic polypeptide

SEQ ID NO: 1029 - DNA, 828 bp, Artificial Sequence; identical to SEQ ID NO: 807
  Description of Artificial Sequence: Synthetic polynucleotide

SEQ ID NO: 1030 - protein, 276 aa, Artificial Sequence; identical to SEQ ID NO: 808
  Description of Artificial Sequence: Synthetic polypeptide

SEQ ID NO: 1031 - DNA, 822 bp, Artificial Sequence; identical to SEQ ID NO: 809
  Description of Artificial Sequence: Synthetic polynucleotide

SEQ ID NO: 1032 - protein, 274 aa, Artificial Sequence; identical to SEQ ID NO: 810
  Description of Artificial Sequence: Synthetic polypeptide

SEQ ID NO: 1033 - DNA, 819 bp, Artificial Sequence; identical to SEQ ID NO: 811
  Description of Artificial Sequence: Synthetic polynucleotide

SEQ ID NO: 1034 - protein, 273 aa, Artificial Sequence; identical to SEQ ID NO: 812
  Description of Artificial Sequence: Synthetic polypeptide

SEQ ID NO: 1035 - DNA, 828 bp, Artificial Sequence; identical to SEQ ID NO: 813
  Description of Artificial Sequence: Synthetic polynucleotide

SEQ ID NO: 1036 - protein, 276 aa, Artificial Sequence; identical to SEQ ID NO: 814
  Description of Artificial Sequence: Synthetic polypeptide

SEQ ID NO: 1037 - DNA, 822 bp, Artificial Sequence; identical to SEQ ID NO: 815
  Description of Artificial Sequence: Synthetic polynucleotide

SEQ ID NO: 1038 - protein, 274 aa, Artificial Sequence; identical to SEQ ID NO: 816
  Description of Artificial Sequence: Synthetic polypeptide

SEQ ID NO: 1039 - DNA, 822 bp, Artificial Sequence; identical to SEQ ID NO: 817
  Description of Artificial Sequence: Synthetic polynucleotide

SEQ ID NO: 1040 - protein, 274 aa, Artificial Sequence; identical to SEQ ID NO: 818
  Description of Artificial Sequence: Synthetic polypeptide

SEQ ID NO: 1041 - DNA, 822 bp, Artificial Sequence; identical to SEQ ID NO: 819
  Description of Artificial Sequence: Synthetic polynucleotide

SEQ ID NO: 1042 - protein, 274 aa, Artificial Sequence; identical to SEQ ID NO: 820
  Description of Artificial Sequence: Synthetic polypeptide

SEQ ID NO: 1043 - DNA, 840 bp, Artificial Sequence; identical to SEQ ID NO: 821
  Description of Artificial Sequence: Synthetic polynucleotide

SEQ ID NO: 1044 - protein, 280 aa, Artificial Sequence; identical to SEQ ID NO: 822
  Description of Artificial Sequence: Synthetic polypeptide

SEQ ID NO: 1045 - DNA, 837 bp, Artificial Sequence; identical to SEQ ID NO: 823
  Description of Artificial Sequence: Synthetic polynucleotide

SEQ ID NO: 1046 - protein, 279 aa, Artificial Sequence; identical to SEQ ID NO: 824
  Description of Artificial Sequence: Synthetic polypeptide

SEQ ID NO: 1047 - DNA, 819 bp, Artificial Sequence; identical to SEQ ID NO: 825
  Description of Artificial Sequence: Synthetic polynucleotide

SEQ ID NO: 1048 - protein, 273 aa, Artificial Sequence; identical to SEQ ID NO: 826
  Description of Artificial Sequence: Synthetic polypeptide

SEQ ID NO: 1049 - DNA, 810 bp, Artificial Sequence; identical to SEQ ID NO: 827
  Description of Artificial Sequence: Synthetic polynucleotide

SEQ ID NO: 1050 - protein, 270 aa, Artificial Sequence; identical to SEQ ID NO: 828
  Description of Artificial Sequence: Synthetic polypeptide

SEQ ID NO: 1051 - DNA, 846 bp, Artificial Sequence; identical to SEQ ID NO: 829
  Description of Artificial Sequence: Synthetic polynucleotide

SEQ ID NO: 1052 - protein, 282 aa, Artificial Sequence; identical to SEQ ID NO: 830
  Description of Artificial Sequence: Synthetic polypeptide

SEQ ID NO: 1053 - DNA, 825 bp, Artificial Sequence; identical to SEQ ID NO: 831
  Description of Artificial Sequence: Synthetic polynucleotide

SEQ ID NO: 1054 - protein, 274 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYWVFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGAFDAFDIWGQGTMVTVSTSGQAGQHHHHHHGAYPYDVPDYAS

SEQ ID NO: 1055 - DNA, 831 bp, Artificial Sequence; identical to SEQ ID NO: 833
  Description of Artificial Sequence: Synthetic polynucleotide

SEQ ID NO: 1056 - protein, 277 aa, Artificial Sequence; identical to SEQ ID NO: 834
  Description of Artificial Sequence: Synthetic polypeptide

SEQ ID NO: 1057 - DNA, 843 bp, Artificial Sequence; identical to SEQ ID NO: 835
  Description of Artificial Sequence: Synthetic polynucleotide

SEQ ID NO: 1058 - protein, 281 aa, Artificial Sequence; identical to SEQ ID NO: 836
  Description of Artificial Sequence: Synthetic polypeptide

SEQ ID NO: 1059 - DNA, 825 bp, Artificial Sequence; identical to SEQ ID NO: 837
  Description of Artificial Sequence: Synthetic polynucleotide

SEQ ID NO: 1060 - protein, 275 aa, Artificial Sequence; identical to SEQ ID NO: 838
  Description of Artificial Sequence: Synthetic polypeptide

SEQ ID NO: 1061 - DNA, 825 bp, Artificial Sequence; identical to SEQ ID NO: 839
  Description of Artificial Sequence: Synthetic polynucleotide

SEQ ID NO: 1062 - protein, 275 aa, Artificial Sequence; identical to SEQ ID NO: 840
  Description of Artificial Sequence: Synthetic polypeptide

SEQ ID NO: 1063 - DNA, 840 bp, Artificial Sequence; identical to SEQ ID NO: 841
  Description of Artificial Sequence: Synthetic polynucleotide

SEQ ID NO: 1064 - protein, 280 aa, Artificial Sequence; identical to SEQ ID NO: 842
  Description of Artificial Sequence: Synthetic polypeptide

SEQ ID NO: 1065 - DNA, 819 bp, Artificial Sequence; identical to SEQ ID NO: 843
  Description of Artificial Sequence: Synthetic polynucleotide

SEQ ID NO: 1066 - protein, 273 aa, Artificial Sequence; identical to SEQ ID NO: 844
  Description of Artificial Sequence: Synthetic polypeptide

SEQ ID NO: 1067 - DNA, 837 bp, Artificial Sequence; identical to SEQ ID NO: 845
  Description of Artificial Sequence: Synthetic polynucleotide

SEQ ID NO: 1068 - protein, 279 aa, Artificial Sequence; identical to SEQ ID NO: 846
  Description of Artificial Sequence: Synthetic polypeptide

SEQ ID NO: 1069 - DNA, 834 bp, Artificial Sequence; identical to SEQ ID NO: 847
  Description of Artificial Sequence: Synthetic polynucleotide

SEQ ID NO: 1070 - protein, 278 aa, Artificial Sequence; identical to SEQ ID NO: 848
  Description of Artificial Sequence: Synthetic polypeptide

SEQ ID NO: 1071 - DNA, 849 bp, Artificial Sequence; identical to SEQ ID NO: 849
  Description of Artificial Sequence: Synthetic polynucleotide

SEQ ID NO: 1072 - protein, 283 aa, Artificial Sequence; identical to SEQ ID NO: 850
  Description of Artificial Sequence: Synthetic polypeptide

SEQ ID NO: 1073 - DNA, 819 bp, Artificial Sequence; identical to SEQ ID NO: 851
  Description of Artificial Sequence: Synthetic polynucleotide

SEQ ID NO: 1074 - protein, 273 aa, Artificial Sequence; identical to SEQ ID NO: 852
  Description of Artificial Sequence: Synthetic polypeptide

SEQ ID NO: 1075 - DNA, 828 bp, Artificial Sequence; identical to SEQ ID NO: 853
  Description of Artificial Sequence: Synthetic polynucleotide

SEQ ID NO: 1076 - protein, 276 aa, Artificial Sequence; identical to SEQ ID NO: 854
  Description of Artificial Sequence: Synthetic polypeptide

SEQ ID NO: 1077 - DNA, 825 bp, Artificial Sequence; identical to SEQ ID NO: 855
  Description of Artificial Sequence: Synthetic polynucleotide

SEQ ID NO: 1078 - protein, 275 aa, Artificial Sequence; identical to SEQ ID NO: 856
  Description of Artificial Sequence: Synthetic polypeptide

SEQ ID NO: 1079 - DNA, 843 bp, Artificial Sequence; identical to SEQ ID NO: 857
  Description of Artificial Sequence: Synthetic polynucleotide

SEQ ID NO: 1080 - protein, 281 aa, Artificial Sequence; identical to SEQ ID NO: 858
  Description of Artificial Sequence: Synthetic polypeptide

SEQ ID NO: 1081 - DNA, 843 bp, Artificial Sequence; identical to SEQ ID NO: 859
  Description of Artificial Sequence: Synthetic polynucleotide

SEQ ID NO: 1082 - protein, 281 aa, Artificial Sequence; identical to SEQ ID NO: 860
  Description of Artificial Sequence: Synthetic polypeptide

SEQ ID NO: 1083 - DNA, 840 bp, Artificial Sequence; identical to SEQ ID NO: 861
  Description of Artificial Sequence: Synthetic polynucleotide

SEQ ID NO: 1084 - protein, 280 aa, Artificial Sequence; identical to SEQ ID NO: 862
  Description of Artificial Sequence: Synthetic polypeptide

SEQ ID NO: 1085 - DNA, 825 bp, Artificial Sequence; identical to SEQ ID NO: 863
  Description of Artificial Sequence: Synthetic polynucleotide

SEQ ID NO: 1086 - protein, 275 aa, Artificial Sequence; identical to SEQ ID NO: 864
  Description of Artificial Sequence: Synthetic polypeptide

SEQ ID NO: 1087 - DNA, 819 bp, Artificial Sequence; identical to SEQ ID NO: 865
  Description of Artificial Sequence: Synthetic polynucleotide

SEQ ID NO: 1088 - protein, 273 aa, Artificial Sequence; identical to SEQ ID NO: 866
  Description of Artificial Sequence: Synthetic polypeptide

SEQ ID NO: 1089 - DNA, 819 bp, Artificial Sequence; identical to SEQ ID NO: 867
  Description of Artificial Sequence: Synthetic polynucleotide

SEQ ID NO: 1090 - protein, 273 aa, Artificial Sequence; identical to SEQ ID NO: 868
  Description of Artificial Sequence: Synthetic polypeptide

SEQ ID NO: 1091 - DNA, 843 bp, Artificial Sequence; identical to SEQ ID NO: 869
  Description of Artificial Sequence: Synthetic polynucleotide

SEQ ID NO: 1092 - protein, 281 aa, Artificial Sequence; identical to SEQ ID NO: 870
  Description of Artificial Sequence: Synthetic polypeptide

SEQ ID NO: 1093 - DNA, 816 bp, Artificial Sequence; identical to SEQ ID NO: 871
  Description of Artificial Sequence: Synthetic polynucleotide

SEQ ID NO: 1094 - protein, 272 aa, Artificial Sequence; identical to SEQ ID NO: 872
  Description of Artificial Sequence: Synthetic polypeptide

SEQ ID NO: 1095 - DNA, 837 bp, Artificial Sequence; identical to SEQ ID NO: 873
  Description of Artificial Sequence: Synthetic polynucleotide

SEQ ID NO: 1096 - protein, 279 aa, Artificial Sequence; identical to SEQ ID NO: 874
  Description of Artificial Sequence: Synthetic polypeptide

SEQ ID NO: 1097 - DNA, 825 bp, Artificial Sequence; identical to SEQ ID NO: 875
  Description of Artificial Sequence: Synthetic polynucleotide

SEQ ID NO: 1098 - protein, 275 aa, Artificial Sequence; identical to SEQ ID NO: 876
  Description of Artificial Sequence: Synthetic polypeptide

SEQ ID NO: 1099 - DNA, 834 bp, Artificial Sequence; identical to SEQ ID NO: 877
  Description of Artificial Sequence: Synthetic polynucleotide

SEQ ID NO: 1100 - protein, 278 aa, Artificial Sequence; identical to SEQ ID NO: 878
  Description of Artificial Sequence: Synthetic polypeptide

SEQ ID NO: 1101 - DNA, 843 bp, Artificial Sequence; identical to SEQ ID NO: 879
  Description of Artificial Sequence: Synthetic polynucleotide

SEQ ID NO: 1102 - protein, 281 aa, Artificial Sequence; identical to SEQ ID NO: 880
  Description of Artificial Sequence: Synthetic polypeptide

SEQ ID NO: 1103 - DNA, 819 bp, Artificial Sequence; identical to SEQ ID NO: 881
  Description of Artificial Sequence: Synthetic polynucleotide

SEQ ID NO: 1104 - protein, 273 aa, Artificial Sequence; identical to SEQ ID NO: 882
  Description of Artificial Sequence: Synthetic polypeptide

SEQ ID NO: 1105 - DNA, 852 bp, Artificial Sequence; identical to SEQ ID NO: 883
  Description of Artificial Sequence: Synthetic polynucleotide

SEQ ID NO: 1106 - protein, 284 aa, Artificial Sequence; identical to SEQ ID NO: 884
  Description of Artificial Sequence: Synthetic polypeptide

SEQ ID NO: 1107 - DNA, 855 bp, Artificial Sequence; identical to SEQ ID NO: 885
  Description of Artificial Sequence: Synthetic polynucleotide

SEQ ID NO: 1108 - protein, 285 aa, Artificial Sequence; identical to SEQ ID NO: 886
  Description of Artificial Sequence: Synthetic polypeptide

SEQ ID NO: 1109 - DNA, 867 bp, Artificial Sequence; identical to SEQ ID NO: 887
  Description of Artificial Sequence: Synthetic polynucleotide

SEQ ID NO: 1110 - protein, 289 aa, Artificial Sequence; identical to SEQ ID NO: 888
  Description of Artificial Sequence: Synthetic polypeptide

SEQ ID NO: 1111 - DNA, 852 bp, Artificial Sequence; identical to SEQ ID NO: 889
  Description of Artificial Sequence: Synthetic polynucleotide

SEQ ID NO: 1112 - protein, 284 aa, Artificial Sequence; identical to SEQ ID NO: 890
  Description of Artificial Sequence: Synthetic polypeptide

SEQ ID NO: 1113 - DNA, 831 bp, Artificial Sequence; identical to SEQ ID NO: 891
  Description of Artificial Sequence: Synthetic polynucleotide

SEQ ID NO: 1114 - protein, 277 aa, Artificial Sequence; identical to SEQ ID NO: 892
  Description of Artificial Sequence: Synthetic polypeptide

SEQ ID NO: 1115 - DNA, 819 bp, Artificial Sequence; identical to SEQ ID NO: 893
  Description of Artificial Sequence: Synthetic polynucleotide

SEQ ID NO: 1116 - protein, 273 aa, Artificial Sequence; identical to SEQ ID NO: 894
  Description of Artificial Sequence: Synthetic polypeptide

SEQ ID NO: 1117 - DNA, 834 bp, Artificial Sequence; identical to SEQ ID NO: 895
  Description of Artificial Sequence: Synthetic polynucleotide

SEQ ID NO: 1118 - protein, 278 aa, Artificial Sequence; identical to SEQ ID NO: 896
  Description of Artificial Sequence: Synthetic polypeptide

SEQ ID NO: 1119 - protein, 33 aa, Artificial Sequence
  Description of Artificial Sequence: Synthetic polypeptide
CLSSERERVEDLFEYECELLTSEPIFHCRQEDC

SEQ ID NO: 1120 - protein, 11 aa, Homo sapiens
LRGSPLILYRF

SEQ ID NO: 1121 - protein, 11 aa, Homo sapiens
LRGSSPILYWF

SEQ ID NO: 1122 - protein, 11 aa, Homo sapiens
APRGSPPILYW

SEQ ID NO: 1123 - protein, 10 aa, Artificial Sequence
  Description of Artificial Sequence: Synthetic peptide
ARNNHYYNDY

SEQ ID NO: 1124 - protein, 907 aa, Artificial Sequence
  Description of Artificial Sequence: Synthetic polypeptide
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSIISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAAAAEQKLISEEDLEQKLISEEDLEQKLISEEDLTGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 1125 - protein, 977 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSIISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGPEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPPDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 1126 - protein, 977 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGPEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPPDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 1127 - protein, 33 aa, Artificial Sequence
  Description of Artificial Sequence: Synthetic polypeptide
CMDYDFKVKLSSERERCWAIGCIFAELLTSEPC

SEQ ID NO: 1128 - protein, 33 aa, Artificial Sequence
  Description of Artificial Sequence: Synthetic polypeptide
CMDYDFKVKLSSERERCCIFAELLTSEPIFHCC

SEQ ID NO: 1129 - protein, 33 aa, Artificial Sequence
  Description of Artificial Sequence: Synthetic polypeptide
CMDYDFKVKLSSERERCELLTSEPIFHCRQEDC

SEQ ID NO: 1130 - protein, 33 aa, Artificial Sequence
  Description of Artificial Sequence: Synthetic polypeptide
CMDYDFKVKLSSERERCSEPIFHCRQEDIKTSC

SEQ ID NO: 1131 - protein, 33 aa, Artificial Sequence
  Description of Artificial Sequence: Synthetic polypeptide
CFKVKLSSERERVEDLCWAIGCIFAELLTSEPC

SEQ ID NO: 1132 - protein, 33 aa, Artificial Sequence
  Description of Artificial Sequence: Synthetic polypeptide
CFKVKLSSERERVEDLCCIFAELLTSEPIFHCC

SEQ ID NO: 1133 - protein, 33 aa, Artificial Sequence
  Description of Artificial Sequence: Synthetic polypeptide
CFKVKLSSERERVEDLCELLTSEPIFHCRQEDC

SEQ ID NO: 1134 - protein, 33 aa, Artificial Sequence
  Description of Artificial Sequence: Synthetic polypeptide
CFKVKLSSERERVEDLCSEPIFHCRQEDIKTSC

SEQ ID NO: 1135 - protein, 33 aa, Artificial Sequence
  Description of Artificial Sequence: Synthetic polypeptide
CLSSERERVEDLFEYECWAIGCIFAELLTSEPC

SEQ ID NO: 1136 - protein, 33 aa, Artificial Sequence
  Description of Artificial Sequence: Synthetic polypeptide
CLSSERERVEDLFEYECCIFAELLTSEPIFHCC

SEQ ID NO: 1137 - protein, 33 aa, Artificial Sequence
  Description of Artificial Sequence: Synthetic polypeptide
CLSSERERVEDLFEYECSEPIFHCRQEDIKTSC

SEQ ID NO: 1138 - protein, 33 aa, Artificial Sequence
  Description of Artificial Sequence: Synthetic polypeptide
CRERVEDLFEYEGCKVCWAIGCIFAELLTSEPC

SEQ ID NO: 1139 - protein, 33 aa, Artificial Sequence
  Description of Artificial Sequence: Synthetic polypeptide
CRERVEDLFEYEGCKVCCIFAELLTSEPIFHCC

SEQ ID NO: 1140 - protein, 33 aa, Artificial Sequence
  Description of Artificial Sequence: Synthetic polypeptide
CRERVEDLFEYEGCKVCELLTSEPIFHCRQEDC

SEQ ID NO: 1141 - protein, 33 aa, Artificial Sequence
  Description of Artificial Sequence: Synthetic polypeptide
CRERVEDLFEYEGCKVCSEPIFHCRQEDIKTSC

SEQ ID NO: 1142 - protein, 15 aa, Artificial Sequence
  Description of Artificial Sequence: Synthetic peptide
MDYDFKVKLSSERER

SEQ ID NO: 1143 - protein, 15 aa, Artificial Sequence
  Description of Artificial Sequence: Synthetic peptide
FKVKLSSERERVEDL

SEQ ID NO: 1144 - protein, 15 aa, Artificial Sequence
  Description of Artificial Sequence: Synthetic peptide
LSSERERVEDLFEYE

SEQ ID NO: 1145 - protein, 15 aa, Artificial Sequence
  Description of Artificial Sequence: Synthetic peptide
RERVEDLFEYEGCKV

SEQ ID NO: 1146 - protein, 15 aa, Artificial Sequence
  Description of Artificial Sequence: Synthetic peptide
WAIGCIFAELLTSEP

SEQ ID NO: 1147 - protein, 15 aa, Artificial Sequence
  Description of Artificial Sequence: Synthetic peptide
CIFAELLTSEPIFHC

SEQ ID NO: 1148 - protein, 15 aa, Artificial Sequence
  Description of Artificial Sequence: Synthetic peptide
ELLTSEPIFHCRQED

SEQ ID NO: 1149 - protein, 15 aa, Artificial Sequence
  Description of Artificial Sequence: Synthetic peptide
SEPIFHCRQEDIKTS

What is claimed is:

1. A chimeric antigen receptor (CAR), comprising an extracellular antigen-binding domain, a transmembrane domain, and an intracellular domain, wherein the extracellular antigen-binding domain specifically binds to Fc Receptor-Like 5 (FcRL5) and comprises:

(a) a light chain variable region comprising a CDR1, a CDR2, and a CDR3 of the light chain variable region sequence set forth in SEQ ID NO:143, and a heavy chain variable region comprising a CDR1, a CDR2, and a CDR3 of the heavy chain variable region sequence set forth in SEQ ID NO:144;

(b) a light chain variable region comprising a CDR1, a CDR2, and a CDR3 of the light chain variable region sequence set forth in SEQ ID NO:215, and a heavy chain variable region comprising a CDR1, a CDR2, and a CDR3 of the heavy chain variable region sequence set forth in SEQ ID NO:216;

(c) a light chain variable region comprising a CDR1, a CDR2, and a CDR3 of the light chain variable region sequence set forth in SEQ ID NO:267, and a heavy chain variable region comprising a CDR1, a CDR2, and a CDR3 of the heavy chain variable region sequence set forth in SEQ ID NO:268; or (d) a light chain variable region comprising a CDR1, a CDR2, and a CDR3 of the light chain variable region sequence set forth in SEQ ID NO:171, and a heavy chain variable region comprising a CDR1, a CDR2, and a CDR3 of the heavy chain variable region sequence set forth in SEQ ID NO:172.

2. The CAR of claim 1, wherein the extracellular antigen-binding domain comprises a single-chain variable fragment (scFv).

3. The CAR of claim 2, wherein the extracellular antigen-binding domain comprises a human scFv.

4. The CAR of claim 2, wherein the scFv is comprised in a fusion protein with a heterologous sequence to form the extracellular antigen-binding domain.

5. The CAR of claim 1, wherein the extracellular antigen-binding domain of the CAR binds to FcRL5 with a binding affinity ($K_d$) of from about $1 \times 10^{-9}$ M to about $3 \times 10^{-6}$ M.

6. The CAR of claim 1, wherein the extracellular antigen-binding domain of the CAR binds to domain 7, domain 8 or domain 9 of FcRL5 with a binding affinity ($K_d$) of from about $1 \times 10^{-9}$ M to about $3 \times 10^{-6}$ M.

7. The CAR of claim 1 wherein the light chain variable region comprises a CDR1 comprising the sequence set forth in SEQ ID NO: 318, a CDR2 comprising the sequence set forth in SEQ ID NO: 319, and a CDR3 comprising the sequence set forth in SEQ ID NO: 419, and the heavy chain variable region comprises a CDR1 comprising the sequence set forth in SEQ ID NO: 411, a CDR2 comprising the sequence set forth in SEQ ID NO: 412, and a CDR3 comprising the sequence set forth in SEQ ID NO: 463.

8. The CAR of claim 1, wherein:
   (a) the light chain variable region comprises an amino acid sequence that has at least about 90% sequence identity to the amino acid sequence set forth in SEQ ID NO:143, and the heavy chain variable region comprises an amino acid sequence that has at least about 90% sequence identity to the amino acid sequence set forth in SEQ ID NO:144;
   (b) the light chain variable region comprises an amino acid sequence that has at least about 90% sequence identity to the amino acid sequence set forth in SEQ ID NO:215, and the heavy chain variable region comprises an amino acid sequence that has at least about 90% sequence identity to the amino acid sequence set forth in SEQ ID NO:216;
   (c) the light chain variable region comprises an amino acid sequence that has at least about 90% sequence identity to the amino acid sequence set forth in SEQ ID NO:267, and the heavy chain variable region comprises an amino acid sequence that has at least about 90% sequence identity to the amino acid sequence set forth in SEQ ID NO:268; or
   (d) the light chain variable region comprises an amino acid sequence that has at least about 90% sequence identity to the amino acid sequence set forth in SEQ ID NO:171, and the heavy chain variable region comprises an amino acid sequence that has at least about 90% sequence identity to the amino acid sequence set forth in SEQ ID NO:172.

9. The CAR of claim 8, wherein:
   (a) the light chain variable region comprises the amino acid sequence set forth in SEQ ID NO:143, and the heavy chain variable region comprises the amino acid sequence set forth in SEQ ID NO:144;
   (b) the light chain variable region comprises the amino acid sequence set forth in SEQ ID NO:215, and the heavy chain variable region comprises the amino acid sequence set forth in SEQ ID NO:216;
   (c) the light chain variable region comprises the amino acid sequence set forth in SEQ ID NO:267, and the heavy chain variable region comprises the amino acid sequence set forth in SEQ ID NO:268; or
   (d) the light chain variable region comprises the amino acid sequence set forth in SEQ ID NO:171, and the heavy chain variable region comprises the amino acid sequence set forth in SEQ ID NO:172.

10. The CAR of claim 9, wherein the light chain variable region comprises the amino acid sequence set forth in SEQ ID NO:143, and the heavy chain variable region comprises the amino acid sequence set forth in SEQ ID NO:144.

11. The CAR of claim 9, wherein the light chain variable region comprises the amino acid sequence set forth in SEQ ID NO:215, and the heavy chain variable region comprises the amino acid sequence set forth in SEQ ID NO:216.

12. The CAR of claim 9, wherein the light chain variable region comprises the amino acid sequence set forth in SEQ ID NO:267, and the heavy chain variable region comprises the amino acid sequence set forth in SEQ ID NO:268.

13. The CAR of claim 9, wherein the light chain variable region comprises the amino acid sequence set forth in SEQ ID NO:171, and the heavy chain variable region comprises the amino acid sequence set forth in SEQ ID NO:172.

14. The CAR of claim 9, wherein the extracellular antigen-binding domain comprises the amino acid sequence set forth in SEQ ID NO:664, SEQ ID NO:700, SEQ ID NO:726, or SEQ ID NO:678.

15. The CAR of claim 7, wherein:
   (a) the transmembrane domain comprises a CD28 polypeptide, and the intracellular domain comprises a CD3ζ polypeptide and a co-stimulatory signaling region that comprises a CD28 polypeptide;
   (b) the transmembrane domain comprises a CD8 polypeptide, and the intracellular domain comprises a CD3ζ polypeptide and a co-stimulatory signaling region that comprises a 4-1BB polypeptide; or
   (c) the transmembrane domain comprises a CD28 polypeptide, and the intracellular domain comprises a CD3ζ polypeptide and a co-stimulatory signaling region that comprises a 4-1BB polypeptide.

16. The CAR of claim 1, wherein the transmembrane domain comprises a CD8 polypeptide, a CD28 polypeptide, a CD3ζ polypeptide, a CD4 polypeptide, a 4-1BB polypeptide, an OX40 polypeptide, an ICOS polypeptide, a CTLA-4 polypeptide, a PD-1 polypeptide, a LAG-3 polypeptide, a 2B4 polypeptide, a BTLA polypeptide, a synthetic peptide, or a combination thereof.

17. The CAR of claim 16, wherein the transmembrane domain comprises a CD8 polypeptide or a CD28 polypeptide.

18. The CAR of claim 1, wherein the intracellular domain comprises a CD3ζ polypeptide.

19. The CAR of claim 18, wherein the intracellular domain further comprises at least one signaling region.

20. The CAR of claim 19, wherein the at least one signaling region comprises a CD28 polypeptide, a 4-1BB polypeptide, an OX40 polypeptide, an ICOS polypeptide, a PD-1 polypeptide, a CTLA-4 polypeptide, a LAG-3 polypeptide, a 2B4 polypeptide, a BTLA polypeptide, a synthetic peptide, or a combination thereof.

21. The CAR of claim 19, wherein the at least one signaling region comprises at least one co-stimulatory signaling region.

22. The CAR of claim 21, wherein the at least one co-stimulatory signaling region comprises a CD28 polypeptide, a 4-1BB polypeptide, an OX40 polypeptide, an ICOS polypeptide, a DAP-10 polypeptide, or a combination thereof.

23. The CAR of claim 21, wherein the at least one co-stimulatory signaling region comprises a CD28 polypeptide or a 4-1BB polypeptide.

24. The CAR of claim 23, wherein:
   (a) the transmembrane domain comprises a CD28 polypeptide, the intracellular domain comprises a CD3ζ polypeptide, and the at least one co-stimulatory signaling region comprises a CD28 polypeptide;
   (b) the transmembrane domain comprises a CD8 polypeptide, the intracellular domain comprises a CD3ζ polypeptide, and the at least one co-stimulatory signaling region comprises a 4-1BB polypeptide; or
   (c) the transmembrane domain comprises a CD28 polypeptide, the intracellular domain comprises a CD3ζ polypeptide, and the at least one co-stimulatory signaling region comprises a 4-1BB polypeptide.

25. The CAR of claim 10, wherein:
   (a) the transmembrane domain comprises a CD28 polypeptide, and the intracellular domain comprises a CD3ζ polypeptide and a co-stimulatory signaling region that comprises a CD28 polypeptide;

(b) the transmembrane domain comprises a CD8 polypeptide, and the intracellular domain comprises a CD3ζ polypeptide and a co-stimulatory signaling region that comprises a 4-1BB polypeptide; or (c) the transmembrane domain comprises a CD28 polypeptide, and the intracellular domain comprises a CD3ζ polypeptide and a co-stimulatory signaling region that comprises a 4-1BB polypeptide.

26. An immunoresponsive cell comprising the CAR of claim 1.

27. The immunoresponsive cell of claim 26, wherein the CAR is constitutively expressed on the surface of the immunoresponsive cell.

28. The immunoresponsive cell of claim 26, wherein the immunoresponsive cell is further transduced with a nucleic acid molecule encoding at least one co-stimulatory ligand such that the immunoresponsive cell expresses the at least one co-stimulatory ligand; or a nucleic acid molecule encoding at least one cytokine such that the immunoresponsive cell secretes the at least one cytokine.

29. The immunoresponsive cell of claim 26, wherein the immunoresponsive cell is selected from the group consisting of a T cell, a Natural Killer (NK) cell, a cytotoxic T lymphocyte (CTL), a regulatory T cell, a human embryonic stem cell, a lymphoid progenitor cell, a T cell-precursor cell, and a pluripotent stem cell from which lymphoid cells may be differentiated.

30. A nucleic acid molecule encoding the CAR of claim 1.

31. The nucleic acid molecule of claim 30, comprising the nucleotide sequence set forth in SEQ ID NO: 954, SEQ ID NO: 956, SEQ ID NO: 959, or SEQ ID NO: 955, or a sequence having at least about 90% identity to the nucleotide sequence set forth in SEQ ID NO:954, SEQ ID NO:956, SEQ ID NO:959, or SEQ ID NO:955.

32. A vector comprising the nucleic acid molecule of claim 30.

33. A host cell expressing the nucleic acid molecule of claim 30.

34. A T cell comprising the CAR of claim 1.

35. A method for producing an immunoresponsive cell that binds to Fc Receptor-Like 5 (FcRL5), comprising introducing into an immunoresponsive cell a nucleic acid molecule that encodes the CAR of claim 1.

36. A pharmaceutical composition comprising an effective amount of the immunoresponsive cell of claim 10 and a pharmaceutically acceptable excipient.

37. A kit for treating a tumor, the kit comprising the immunoresponsive cell of claim 10 and written instructions for using the immunoresponsive cell for treating a subject having a tumor.

38. The kit of claim 37, wherein the tumor is selected from the group consisting of multiple myeloma, Non-Hodgkin Lymphoma, Mantle Cell Lymphoma, Hodgkin Lymphoma, Chronic Lymphocytic Leukemia (CLL), Acute lymphocytic leukemia (ALL), Hairy Cell Leukemia, Burkitt's Lymphoma, and Waldenstrom's Macroglobulinemia.

39. The CAR of claim 11, wherein:
(a) the transmembrane domain comprises a CD28 polypeptide, and the intracellular domain comprises a CD3ζ polypeptide and a co-stimulatory signaling region that comprises a CD28 polypeptide;
(b) the transmembrane domain comprises a CD8 polypeptide, and the intracellular domain comprises a CD3ζ polypeptide and a co-stimulatory signaling region that comprises a 4-1BB polypeptide; or
(c) the transmembrane domain comprises a CD28 polypeptide, and the intracellular domain comprises a CD3ζ polypeptide and a co-stimulatory signaling region that comprises a 4-1BB polypeptide.

40. The CAR of claim 12, wherein:
(a) the transmembrane domain comprises a CD28 polypeptide, and the intracellular domain comprises a CD3ζ polypeptide and a co-stimulatory signaling region that comprises a CD28 polypeptide;
(b) the transmembrane domain comprises a CD8 polypeptide, and the intracellular domain comprises a CD3ζ polypeptide and a co-stimulatory signaling region that comprises a 4-1BB polypeptide; or
(c) the transmembrane domain comprises a CD28 polypeptide, and the intracellular domain comprises a CD3ζ polypeptide and a co-stimulatory signaling region that comprises a 4-1BB polypeptide.

41. The CAR of claim 13, wherein:
(a) the transmembrane domain comprises a CD28 polypeptide, and the intracellular domain comprises a CD3ζ polypeptide and a co-stimulatory signaling region that comprises a CD28 polypeptide;
(b) the transmembrane domain comprises a CD8 polypeptide, and the intracellular domain comprises a CD3ζ polypeptide and a co-stimulatory signaling region that comprises a 4-1BB polypeptide; or
(c) the transmembrane domain comprises a CD28 polypeptide, and the intracellular domain comprises a CD3ζ polypeptide and a co-stimulatory signaling region that comprises a 4-1BB polypeptide.

42. A nucleic acid molecule encoding the CAR of claim 7.

43. A vector comprising the nucleic acid molecule of claim 42.

44. An immunoresponsive cell comprising the CAR of claim 7.

45. A T cell comprising the CAR of claim 7.

46. The CAR of claim 1, wherein the light chain variable region comprises a CDR1 comprising the sequence set forth in SEQ ID NO: 318, a CDR2 comprising the sequence set forth in SEQ ID NO: 319, and a CDR3 comprising the sequence set forth in SEQ ID NO: 531, and the heavy chain variable region comprises a CDR1 comprising the sequence set forth in SEQ ID NO: 515, a CDR2 comprising the sequence set forth in SEQ ID NO: 516, and a CDR3 comprising the sequence set forth in SEQ ID NO: 517.

47. The CAR of claim 1, wherein the light chain variable region comprises a CDR1 comprising the sequence set forth in SEQ ID NO: 571, a CDR2 comprising the sequence set forth in SEQ ID NO: 572, and a CDR3 comprising the sequence set forth in SEQ ID NO: 573, and the heavy chain variable region comprises a CDR1 comprising the sequence set forth in SEQ ID NO: 372, a CDR2 comprising the sequence set forth in SEQ ID NO: 475, and a CDR3 comprising the sequence set forth in SEQ ID NO: 570.

48. The CAR of claim 1, wherein the light chain variable region comprises a CDR1 comprising the sequence set forth in SEQ ID NO: 490, a CDR2 comprising the sequence set forth in SEQ ID NO: 313, and a CDR3 comprising the sequence set forth in SEQ ID NO: 491, and the heavy chain variable region comprises a CDR1 comprising the sequence set forth in SEQ ID NO: 309, a CDR2 comprising the sequence set forth in SEQ ID NO: 310, and a CDR3 comprising the sequence set forth in SEQ ID NO: 489.

49. The CAR of claim 46, wherein:
(a) the transmembrane domain comprises a CD28 polypeptide, and the intracellular domain comprises a CD3ζ polypeptide and a co-stimulatory signaling region that comprises a CD28 polypeptide;
(b) the transmembrane domain comprises a CD8 polypeptide, and the intracellular domain comprises a CD3ζ polypeptide and a co-stimulatory signaling region that comprises a 4-1BB polypeptide; or
(c) the transmembrane domain comprises a CD28 polypeptide, and the intracellular domain comprises a CD3ζ polypeptide and a co-stimulatory signaling region that comprises a 4-1BB polypeptide.

50. The CAR of claim 47, wherein:
(a) the transmembrane domain comprises a CD28 polypeptide, and the intracellular domain comprises a CD3ζ polypeptide and a co-stimulatory signaling region that comprises a CD28 polypeptide;
(b) the transmembrane domain comprises a CD8 polypeptide, and the intracellular domain comprises a CD3ζ polypeptide and a co-stimulatory signaling region that comprises a 4-1BB polypeptide; or
(c) the transmembrane domain comprises a CD28 polypeptide, and the intracellular domain comprises a CD3ζ polypeptide and a co-stimulatory signaling region that comprises a 4-1BB polypeptide.

51. The CAR of claim 48, wherein:
(a) the transmembrane domain comprises a CD28 polypeptide, and the intracellular domain comprises a CD3ζ polypeptide and a co-stimulatory signaling region that comprises a CD28 polypeptide;
(b) the transmembrane domain comprises a CD8 polypeptide, and the intracellular domain comprises a CD3ζ polypeptide and a co-stimulatory signaling region that comprises a 4-1BB polypeptide; or
(c) the transmembrane domain comprises a CD28 polypeptide, and the intracellular domain comprises a CD3ζ polypeptide and a co-stimulatory signaling region that comprises a 4-1BB polypeptide.

52. A nucleic acid molecule encoding the CAR of claim 46.

53. A vector comprising the nucleic acid molecule of claim 52.

54. An immunoresponsive cell comprising the CAR of claim 46.

55. A T cell comprising the CAR of claim 46.

56. A nucleic acid molecule encoding the CAR of claim 47.

57. A vector comprising the nucleic acid molecule of claim 56.

58. An immunoresponsive cell comprising the CAR of claim 47.

59. A T cell comprising the CAR of claim 47.

60. A nucleic acid molecule encoding the CAR of claim 48.

61. A vector comprising the nucleic acid molecule of claim 60.

62. An immunoresponsive cell comprising the CAR of claim 48.

63. A T cell comprising the CAR of claim 48.

* * * * *